US012509524B2

(12) United States Patent
Igawa et al.

(10) Patent No.: US 12,509,524 B2
(45) Date of Patent: Dec. 30, 2025

(54) ANTIGEN-BINDING MOLECULE COMPRISING ALTERED ANTIBODY VARIABLE REGION

(71) Applicant: Chugai Seiyaku Kabushiki Kaisha, Tokyo (JP)

(72) Inventors: Tomoyuki Igawa, Singapore (SG); Shu Feng, Singapore (SG); Shu Wen Samantha Ho, Singapore (SG); Hirotake Shiraiwa, Shizuoka (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 1168 days.

(21) Appl. No.: 17/280,239

(22) PCT Filed: Sep. 27, 2019

(86) PCT No.: PCT/JP2019/038087
§ 371 (c)(1),
(2) Date: Mar. 26, 2021

(87) PCT Pub. No.: WO2020/067399
PCT Pub. Date: Apr. 2, 2020

(65) Prior Publication Data
US 2022/0112296 A1 Apr. 14, 2022

(30) Foreign Application Priority Data
Sep. 28, 2018 (JP) ................................ 2018-185120

(51) Int. Cl.
*C07K 16/28* (2006.01)
*C07K 16/30* (2006.01)

(52) U.S. Cl.
CPC ...... *C07K 16/2878* (2013.01); *C07K 16/2809* (2013.01); *C07K 16/303* (2013.01);
(Continued)

(58) Field of Classification Search
CPC ............ C07K 16/2878; C07K 16/2809; C07K 16/303; C07K 2317/31; C07K 2317/522;
(Continued)

(56) References Cited

U.S. PATENT DOCUMENTS 6,344,443 B1 2/2002 Liu et al.
9,334,331 B2 * 5/2016 Igawa ........................ A61P 7/00
(Continued)

FOREIGN PATENT DOCUMENTS

CN 1069124 2/1993
CN 101123983 2/2008
(Continued)

OTHER PUBLICATIONS

Janeway CA Jr, Travers P, Walport M, et al. Immunobiology: The Immune System in Health and Disease. 5th edition. New York: Garland Science; 2001. The interaction of the antibody molecule with specific antigen. Available from: https://www.ncbi.nlm.nih.gov/books/NBK27160/ (Year: 2001).*
(Continued)

*Primary Examiner* — Joanne Hama
*Assistant Examiner* — Jami Michelle Gurley
(74) *Attorney, Agent, or Firm* — Fish & Richardson P.C.

(57) ABSTRACT

An antigen-binding molecule capable of binding to multiple different antigens (e.g., CD3 on T cells, and CD137 on T cells, NK cells, DC cells, and/or the like), but does not nonspecifically crosslink two or more immune cells such as T cells is provided. Such multispecific antigen-binding molecule is capable of modulating and/or activating an immune response while circumventing the cross-linking between different cells (e.g., different T cells) resulting from the binding of a conventional multispecific antigen-binding molecule to antigens expressed on the different cells, which
(Continued)

is considered to be responsible for adverse reactions when the multispecific antigen-binding molecule is used as a drug.

21 Claims, 51 Drawing Sheets

Specification includes a Sequence Listing.

(52) U.S. Cl.
CPC .... *C07K 2317/31* (2013.01); *C07K 2317/522* (2013.01); *C07K 2317/53* (2013.01); *C07K 2317/55* (2013.01); *C07K 2317/71* (2013.01); *C07K 2317/73* (2013.01); *C07K 2317/92* (2013.01)

(58) Field of Classification Search
CPC ............ C07K 2317/53; C07K 2317/55; C07K 2317/71; C07K 2317/73; C07K 2317/92; C07K 2317/526; C07K 2317/35; C07K 2317/56; C07K 2317/565; C07K 2317/75; C07K 2317/94; C07K 16/468; C07K 16/2896; C12N 15/1034
See application file for complete search history.

(56) References Cited

U.S. PATENT DOCUMENTS

| | | | |
|---|---|---|---|
| 11,154,615 | B2 | 10/2021 | Igawa et al. |
| 11,274,151 | B2 | 3/2022 | Naoi et al. |
| 11,718,672 | B2 | 8/2023 | Naoi et al. |
| 11,739,149 | B2 | 8/2023 | Igawa et al. |
| 11,952,422 | B2 | 4/2024 | Shimizu et al. |
| 2006/0121042 | A1 | 6/2006 | Dallaqua et al. |
| 2007/0071675 | A1 | 3/2007 | Wu et al. |
| 2007/0237767 | A1 | 10/2007 | Lazar et al. |
| 2007/0286859 | A1 | 12/2007 | Lazar et al. |
| 2008/0014205 | A1 | 1/2008 | Horowitz et al. |
| 2010/0150918 | A1 | 6/2010 | Kufer et al. |
| 2010/0322946 | A1 | 12/2010 | Bostrom et al. |
| 2012/0328624 | A1 | 12/2012 | Yoshida et al. |
| 2013/0129723 | A1 | 5/2013 | Blankenship et al. |
| 2014/0112914 | A1 | 4/2014 | Nezu et al. |
| 2014/0242077 | A1 | 8/2014 | Choi et al. |
| 2014/0341906 | A1 | 11/2014 | Taylor et al. |
| 2015/0166636 | A1 | 6/2015 | Igawa et al. |
| 2016/0264960 | A1 | 9/2016 | Ishii et al. |
| 2016/0280787 | A1 | 9/2016 | Igawa et al. |
| 2017/0037130 | A1 | 2/2017 | Raum et al. |
| 2017/0274072 | A1 | 9/2017 | Kumagai et al. |
| 2017/0306036 | A1 | 10/2017 | Vu et al. |
| 2018/0201691 | A1 | 7/2018 | Hudson |
| 2018/0296668 | A1 | 10/2018 | Igawa et al. |
| 2019/0119406 | A1 | 4/2019 | Zhang |
| 2020/0332001 | A1 | 10/2020 | Igawa et al. |
| 2020/0377595 | A1 | 12/2020 | Shimizu et al. |
| 2021/0301016 | A1 | 9/2021 | Naoi et al. |
| 2021/0388087 | A1 | 12/2021 | Ho et al. |
| 2022/0040297 | A1 | 2/2022 | Igawa et al. |
| 2022/0251201 | A1 | 8/2022 | Naoi et al. |
| 2023/0121511 | A1 | 4/2023 | Chichili et al. |
| 2024/0010725 | A1 | 1/2024 | Naoi et al. |
| 2024/0026000 | A1 | 1/2024 | Igawa et al. |
| 2024/0270846 | A1 | 8/2024 | Shimizu et al. |

FOREIGN PATENT DOCUMENTS

| | | | | | |
|---|---|---|---|---|---|
| EP | 1 293 514 | A | | 3/2003 | |
| EP | 1 752 471 | A | | 2/2007 | |
| EP | 2 647 707 | A | | 10/2013 | |
| EP | 2 731 970 | A | | 5/2014 | |
| EP | 3 070 168 | A | | 9/2016 | |
| EP | 3 130 606 | A | | 2/2017 | |
| EP | 3 219 724 | A | | 9/2017 | |
| EP | 3 305 322 | A | | 4/2018 | |
| EP | 3227332 | B1 | * | 11/2019 | ........... A61K 39/395 |
| EP | 3 831 854 | A | | 6/2021 | |
| JP | 2007-536912 | | | 12/2007 | |
| JP | 2008-518023 | | | 5/2008 | |
| JP | 2008-526809 | | | 7/2008 | |
| JP | 2010-524851 | | | 7/2010 | |
| JP | 2012-501648 | | | 1/2012 | |
| JP | 2021-508441 | A | | 3/2021 | |
| JP | 2021-159081 | A | | 10/2021 | |
| RU | 2010/129549 | A | | 1/2012 | |
| RU | 2014/109551 | | | 9/2015 | |
| RU | 2016/143383 | | | 5/2018 | |
| WO | WO 92/19973 | | | 11/1992 | |
| WO | WO 94/18221 | | | 8/1994 | |
| WO | WO 95/14714 | | | 6/1995 | |
| WO | WO 00/42072 | | | 7/2000 | |
| WO | WO 01/77342 | | | 10/2001 | |
| WO | WO 2005/070966 | | | 8/2005 | |
| WO | WO 2006/019447 | | | 2/2006 | |
| WO | WO 2006/047340 | | | 5/2006 | |
| WO | WO 2006/047639 | | | 5/2006 | |
| WO | WO 2006/072620 | | | 7/2006 | |
| WO | WO 2006/083706 | | | 8/2006 | |
| WO | WO 2008/119567 | | | 10/2008 | |
| WO | WO 2008/157379 | | | 12/2008 | |
| WO | WO 2009/025846 | | | 2/2009 | |
| WO | WO 2009/080252 | A1 | | 7/2009 | |
| WO | WO 2010/027981 | | | 3/2010 | |
| WO | WO 2010/035012 | | | 4/2010 | |
| WO | WO 2010/080538 | | | 7/2010 | |
| WO | WO 2011/093097 | | | 8/2011 | |
| WO | WO 2011/133886 | | | 10/2011 | |
| WO | WO 2012/064792 | | | 5/2012 | |
| WO | WO-2012064792 | A2 | * | 5/2012 | ............ C07K 16/00 |
| WO | WO 2012/073985 | | | 6/2012 | |
| WO | WO 2012/096994 | | | 7/2012 | |
| WO | WO 2012/143524 | | | 10/2012 | |
| WO | WO 2012/162067 | | | 11/2012 | |
| WO | WO 2012/162068 | A2 | | 11/2012 | |
| WO | WO 2013/026833 | | | 2/2013 | |
| WO | WO 2013/026839 | | | 2/2013 | |
| WO | WO 2013/055958 | | | 4/2013 | |
| WO | WO 2013/059593 | | | 4/2013 | |
| WO | WO 2013/093809 | | | 6/2013 | |
| WO | WO 2013/126746 | | | 8/2013 | |
| WO | WO 2013/180200 | | | 12/2013 | |
| WO | WO 2013/187495 | | | 12/2013 | |
| WO | WO 2014/116846 | | | 7/2014 | |
| WO | WO 2015/068847 | | | 5/2015 | |
| WO | WO 2015/138615 | | | 9/2015 | |
| WO | WO 2015/156268 | | | 10/2015 | |
| WO | WO 2016/040856 | | | 3/2016 | |
| WO | WO 2016/076345 | | | 5/2016 | |
| WO | WO 2016/122702 | A1 | | 8/2016 | |
| WO | WO-2016194992 | A1 | * | 12/2016 | ........... A61K 39/395 |
| WO | WO 2017/021349 | | | 2/2017 | |
| WO | WO-2017070608 | A1 | * | 4/2017 | ............ A61K 35/17 |
| WO | WO 2017/096361 | A1 | | 6/2017 | |
| WO | WO 2017/191101 | | | 11/2017 | |
| WO | WO 2018/027204 | | | 2/2018 | |
| WO | WO 2018/114748 | | | 6/2018 | |
| WO | WO 2018/114754 | | | 6/2018 | |
| WO | WO-2018162517 | A1 | * | 9/2018 | ............ C07K 16/00 |
| WO | WO 2018/232088 | | | 12/2018 | |
| WO | WO 2019/111871 | | | 6/2019 | |
| WO | WO 2019/131988 | | | 7/2019 | |
| WO | WO 2019/234220 | A1 | | 12/2019 | |
| WO | WO 2020/027330 | | | 2/2020 | |
| WO | WO 2020/067399 | | | 4/2020 | |
| WO | WO 2020/067419 | | | 4/2020 | |
| WO | WO 2020/076977 | A2 | | 4/2020 | |
| WO | WO 2021/157679 | | | 8/2021 | |
| WO | WO 2021/200898 | | | 10/2021 | |

(56) References Cited

FOREIGN PATENT DOCUMENTS

WO WO 2021/201087 10/2021
WO WO 2023/054423 A1 4/2023

OTHER PUBLICATIONS

Chiu et al. Antibody Structure and Function: The Basis for Engineering Therapeutics. Antibodies (Basel). Dec. 3, 2019;8(4):55. doi: 10.3390/antib8040055 (Year: 2019).*
Clark et al. Influence of canonical structure determining residues on antibody affinity and stability. J Struct Biol. Feb. 2014;185(2):223-7. doi: 10.1016/j.jsb.2013.08.009 (Year: 2013).*
Hummer AM, Abanades B, Deane CM. Advances in computational structure-based antibody design. Curr Opin Struct Biol. Jun. 2022;74:102379. doi: 10.1016/j.sbi.2022.102379. Epub Apr. 28, 2022. PMID: 35490649. (Year: 2022).*
Shang et al. (Characterization of the native and denatured Herceptin by enzyme linked immunosorbent assay and quartz crystal microbalance using a high-affinity single chain fragment variable recombinant antibody. Anal Chem. Oct. 2, 2012;84(19):8164-70. doi: 10.1021/ac301235a (Year: 2012).*
Bostrom et al. (Variants of the antibody Herceptin that interact with HER2 and VEGF at the antigen binding site. Science. Mar. 20, 2009;323(5921):1610-4. doi: 10.1126/science.1165480 (Year: 2009).*
Bostrom et al. (Variants of the antibody Herceptin that interact with HER2 and VEGF at the antigen binding site. Science. Mar. 20, 2009;323(5921):1610-4. doi: 10.1126/science.1165480 Supplementary. (Year: 2009).*
Escobar-Cabrera E, Lario P, Baardsnes J, Schrag J, Durocher Y, Dixit S. Asymmetric Fc Engineering for Bispecific Antibodies with Reduced Effector Function. Antibodies (Basel). May 16, 2017;6(2):7. doi: 10.3390/antib6020007. PMID: 31548523; PMCID: PMC6698841. (Year: 2017).*
Schlothauer et al. (Novel human IgG1 and IgG4 Fc-engineered antibodies with completely abolished immune effector functions. Protein Eng Des Sel. Oct. 2016;29(10):457-466. doi: 10.1093/protein/gzw040 (Year: 2016).*
Somasundaram C, Sundarapandiyan K, Keler T, Deo YM, Graziano RF. Development of a trispecific antibody conjugate that directs two distinct tumor-associated antigens to CD64 on myeloid effector cells. Hum Antibodies. 1999;9(1):47-54. PMID: 10331185. (Year: 1999).*
U.S. Appl. No. 15/035,098, Igawa et al., filed May 6, 2016 (abandoned).
U.S. Appl. No. 16/704,464, Igawa et al., filed Dec. 5, 2019.
U.S. Appl. No. 15/525,603, Igawa et al., filed May 10, 2017.
U.S. Appl. No. 16/769,299, Shimizu et al., filed Jun. 3, 2020.
U.S. Appl. No. 17/272,972, Ho et al., filed Mar. 3, 2021.
U.S. Appl. No. 17/216,981, Naoi et al., filed Mar. 30, 2021.
U.S. Appl. No. 17/264,388, Shiraiwa et al., filed Jan. 29, 2021.
U.S. Appl. No. 17/264,388, filed Jan. 29, 2021, Shiraiwa et al.
U.S. Appl. No. 17/272,972, filed Mar. 3, 2021, Ho et al.
Ashkenazi, “Directing cancer cells to self-destruct with pro-apoptotic receptor agonists,” Nat Rev Drug Discov, Dec. 2008, 7(12):1001-1012.
Brinkmann et al., “The making of bispecific antibodies,” mAbs, Feb./Mar. 2017, 9(2):182-212.
Carter et al., “Next generation antibody drugs: pursuit of the ‘high-hanging fruit’,” Nat Rev Drug Discov, Mar. 2018, 17(3):197-223. doi: 10.1038/nrd.2017.227.
Chan et al., “Therapeutic antibodies for autoimmunity and inflammation,” Nat Rev Immunol, May 2010, 10(5):301-316. doi: 10.1038/nri2761.
Clackson et al., “Making antibody fragments using phage display libraries,” Nature, Aug. 15, 1991, 352(6336):624-628.
Clark, “IgG effector mechanisms,” Chem Immunol, 1997, 65:88-110.
Dillon et al., “Structural and Functional Characterization of Disulfide Isoforms of the Human IgG2 Subclass,” J Biol Chem, Jun. 6, 2008, 283(23):16206-16215. Epub Mar. 12, 2008.
Dubrot et al., “Treatment with anti-CD137 mAbs causes intense accumulations of liver T cells without selective antitumor immunotherapeutic effects in this organ,” Cancer Immunol Immunother, Aug. 2010, 59(8):1223-1233.
Ferran et al., “Cytokine-related syndrome following injection of anti-CD3 monoclonal antibody: Further evidence for transient in vivo T cell activation,” Eur J Immunol, Mar. 1990, 20(3):509-515.
Frey et al., “Cytokine release syndrome with novel therapeutics for acute lymphoblastic leukemia,” Hematology Am Soc Hematol Educ Program, Dec. 2, 2016, 2016(1):567-572.
Golay et al., “Design and Validation of a Novel Generic Platform for the Production of Tetravalent IgG1-like Bispecific Antibodies,” J Immunol, Apr. 1, 2016, 196(7):3199-3211.
Greenwood et al., “Structural motifs involved in human IgG antibody effector functions,” Eur J Immunol, May 1993, 23(5):1098-1104.
Hess et al., “Cancer therapy with trifunctional antibodies: linking innate and adaptive immunity,” Future Oncol, Jan. 2012, 8(1):73-85. doi: 10.2217/fon.11.138.
Hill et al., “Human antibody-based chemically induced dimerizers for cell therapeutic applications,” Nat Chem Biol, Feb. 2018, 14(2):112-117. doi:10.1038/nchembio.2529.
Houot et al., “Therapeutic effect of CD137 immunomodulation in lymphoma and its enhancement by $T_{reg}$ depletion,” Blood, Oct. 15, 2009, 114(16):3431-3438.
Huet et al., “Multivalent nanobodies targeting death receptor 5 elicit superior tumor cell killing through efficient caspase induction,” mAbs, Nov./Dec. 2014, 6(6):1560-1570.
Igawa et al., “Antibody recycling by engineered pH-dependent antigen binding improves the duration of antigen neutralization,” Nat Biotechnol, Nov. 2010, 28(11):1203-1207. Epub Oct. 17, 2010.
Ishiguro et al., “An anti-glypican 3/CD3 bispecific T cell-redirecting antibody for treatment of solid tumors,” Sci Transl Med, Oct. 4, 2017, 9(410). pii: eaal4291. doi: 10.1126/scitranslmed.aal4291.
Jefferis et al., “Interaction sites on human IgG-Fc for Fc gamma R: current models,” Immunol Lett, Jun. 3, 2002, 82(1-2):57-65.
Jo et al., “Engineering therapeutic antibodies targeting G-protein-coupled receptors,” Exp Mol Med, Feb. 5, 2016, 48(2):e207.
Jones et al., “Growth factor receptor interplay and resistance in cancer,” Endocr Relat Cancer, Dec. 2006, 13 Suppl 1:S45-51.
Jong et al., “A Novel Platform for the Potentiation of Therapeutic Antibodies Based on Antigen-Dependent Formation of IgG Hexamers at the Cell Surface,” PLoS Biol, Jan. 6, 2016, 14(1):e1002344.
Kontermann, “Dual targeting strategies with bispecific antibodies,” mAbs, Mar.-Apr. 2012, 4(2):182-197. doi: 10.4161/mabs.4.2.19000. Epub Mar. 1, 2012.
Lazar et al., “Engineered antibody Fc variants with enhanced effector function,” Proc Natl Acad Sci USA, Mar. 2006, 103(11):4005-4010. Epub Mar. 6, 2006.
Lee et al., “Cell-type specific potent Wnt signaling blockade by bispecific antibody,” Sci Rep, Jan. 15, 2018, 8(1):766.
Li et al., “Antitumor activities of agonistic anti-TNFR antibodies require differential FcγRIIB coengagement in vivo,” Proc Natl Acad Sci USA, Nov. 26, 2013, 110(48):19501-19606. doi: 10.1073/pnas.1319502110. Epub Nov. 11, 2013.
Mimoto et al., “Fc Engineering to Improve the Function of Therapeutic Antibodies,” Curr Pharm Biotechnol, 2016, 17(15):1298-1314. doi: 10.2174/1389201017666160824161854.
Morgan et al., “The N-terminal end of the $C_H2$ domain of chimeric human IgG1 anti-HLA-DR is necessary for C1q, Fc gamma RI and Fc gamma RIII binding,” Immunology, Oct. 1995, 86(2):319-324.
Mukai et al., “Codon reassignment in the Escherichia coli genetic code,” Nucleic Acids Res, Dec. 2010, 38(22):8188-8195.
Nimmerjahn et al., “Fcgamma receptors as regulators of immune responses,” Nat Rev Immunol, Jan. 2008, 8(1):34-47.
Orita et al., “A novel therapeutic approach for thrombocytopenia by minibody agonist of the thrombopoietin receptor,” Blood, Jan. 15, 2005, 105(2):562-566 [Epub Sep. 16, 2004].
Pavlou et al., “The therapeutic antibodies market to 2008,” Eur J Pharm Biopharm, Apr. 2005, 59(3):389-396.

(56) References Cited

OTHER PUBLICATIONS

Peggs et al., "Cancer immunotherapy: co-stimulatory agonists and co-inhibitory agonists," Clin Exp Immunol, Jul. 2009, 157(1):9-19. doi: 10.1111/j.1365-2249.2009.03912.x. Epub Feb. 18, 2009.
Porter et al., "Chimeric Antigen Receptor-Modified T Cells in Chronic Lymphoid Leukemia," N Engl J Med, Aug. 25, 2011, 365(8):725-733. doi: 10.1056/NEJMoa1103849. Epub Aug. 10, 2011.
Rader, "DARTs take aim at BiTEs," Blood, Apr. 28, 2011, 117(17):4403-4404.
Reichert et al., "Monoclonal antibody successes in the clinic," Nat Biotechnol, Sep. 2005, 23(9):1073-1078.
Riechelmann et al., "Adoptive therapy of head and neck squamous cell carcinoma with antibody coated immune cells: a pilot clinical trial," Cancer Immunol Immunother, Sep. 2007, 56(9):1397-1406. Epub Feb. 2, 2007.
Rothe et al., "Recombinant proteins in rheumatology—recent advances," N Biotechnol, Sep. 2011, 28(5):502-510. doi: 10.1016/j.nbt.2011.03.019. Epub Apr. 5, 2011.
Schabowsky et al., "A Novel Form of 4-1BBL Has Better Immunomodulatory Activity than an Agonistic Anti-4-1BB Ab without Ab Associated Severe Toxicity," Vaccine, Dec. 11, 2009, 28(2):512-522. doi: 10.1016/j.vaccine.2009.09.127. Epub Oct. 29, 2009.
Scheer et al., "Reorienting the Fab Domains of Trastuzumab Results in Potent HER2 Activators," PLoS One, Dec. 2012, 7(12):e51817.
Seimetz et al., "Development and approval of the trifunctional antibody catumaxomab (anti-EpCAM x anti-CD3) as a targeted cancer immunotherapy," Cancer Treat Rev, Oct. 2010, 36(6):458-467. doi: 10.1016/j.ctrv.2010.03.001. Epub Mar. 27, 2010.
Shinkawa et al., "The absence of fucose but not the presence of galactose or bisecting N-acetylglucosamine of human IgG1 complex-type oligosaccharides shows the critical role of enhancing antibody-dependent cellular cytotoxicity," J Biol Chem, Jan. 31, 2003, 278(5):3466-3473. Epub Nov. 8, 2002.
Unkeless et al., "Structure and function of human and murine receptors for IgG," Annu Rev Immunol, Apr. 1988, 6:251-281.
Vinay et al., "4-1BB signaling beyond T Cells," Cell Mol Immunol, Jul. 2011, 8(4):281-284. doi: 10.1038/cmi.2010.82. Epub Jan. 10, 2011.
Wozniak-Knopp et al., "Introducing antigen-binding sites in structural loops of immunoglobulin constant domains: Fc fragments with engineered HER2/neu-binding sites and antibody properties," Protein Eng Des Sel, Apr. 2010, 23(4):289-297. doi: 10.1093/protein/gzq005. Epub Feb. 11, 2010.
Zeidler et al., "Simultaneous activation of T cells and accessory cells by a new class of intact bispecific antibody results in efficient tumor cell killing," J Immunol, Aug. 1, 1999, 163(3):1246-1252.
Zhang et al., "Selection of antibodies that regulate phenotype from intracellular combinatorial antibody libraries," Proc Natl Acad Sci USA, Sep. 25, 2012:109(39):15728-15733.
International Search Report and Written Opinion for App. Ser. No. PCT/JP2019/038087, mailed Dec. 24, 2019, 11 pages.
International Preliminary Report on Patentability in International Application No. PCT/JP2019/038087, dated Mar. 23, 2021, 8 pages.
Edwards et al., "The Remarkable Flexibility of the Human Antibody Repertoire; Isolation of Over One Thousand Different Antibodies to a Single Protein, BLyS," J Mol Biol, Nov. 14, 2003, 334(1):103-118.
Lloyd et al., "Modelling the human immune response: performance of a $10^{11}$ human antibody repertoire against a broad panel of therapeutically relevant antigens," Protein Engineering, Design & Selection, Mar. 2009, 22:159-168.
Nezu, Chugai's Strategy for Drug Discovery Research, Dec. 9, 2019, 81 pages.
Piche-Nicholas et al., "Changes in complementarity-determining regions significantly alter IgG binding to the neonatal Fc receptor (FcRn) and pharmacokinetics," mAbs, Jan. 2018, 10(1):81-94.
U.S. Appl. No. 17/797,540, Kawa, filed Aug. 4, 2022.
U.S. Appl. No. 17/797,540, filed Aug. 4, 2022, Kawa.
U.S. Appl. No. 18/436,917, Shimizu et al., Feb. 8, 2024.
U.S. Appl. No. 18/436,917, filed Feb. 8, 2024, Shimizu et al.
Jakob et al., "Structure reveals function of the dual variable domain immunoglobulin (DVD-Ig) molecule," mAbs, May-Jun. 2013, 5(3):358-363.
Kinder et al., "Engineered Protease-resistant Antibodies with Selectable Cell-killing Functions," The Journal of Biological Chemistry, Oct. 25, 2013, 288(43):30843-30854.
Pan et al., "Blocking Neuropilin-1 Function has an Additive Effect with Anti-VEGF to Inhibit Tumor Growth," Cancer Cell, Jan. 2007, 11:53-67.
Wu et al., "Molecular construction and optimization of anti-human IL-1α/β dual variable domain immunoglobulin (DVD-Ig) molecules," mAbs, Jul.-Aug. 2009, 1(4):339-347. doi: 10.4161/mabs.1.4.8755.
USPTO Non-Final Office Action in U.S. Appl. No. 17/264,388, dated Feb. 12, 2024, 21 pages.
U.S. Appl. No. 18/343,850, Naoi et al., filed Jun. 29, 2023.
U.S. Appl. No. 18/345,750, Igawa et al., filed Jun. 30, 2023.
U.S. Appl. No. 18/343,850, filed Jun. 29, 2023, Naoi et al.
U.S. Appl. No. 18/345,750, filed Jun. 30, 2023, Igawa et al.
U.S. Appl. No. 17/506,733, Igawa et al., filed Oct. 21, 2021.
U.S. Appl. No. 17/506,733, filed Oct. 21, 2021, Igawa et al.
Amann et al., "Therapeutic window of an EpCAM/CD3-specific BiTE antibody in mice is determined by a subpopulation of EpCAM-expressing lymphocytes that is absent in humans," Cancer Immunol Immunother, Jan. 2009, 58(1):95-109. Epub Jul. 2, 2008.
Baeuerle et al., "Bispecific T-Cell Engaging Antibodies for Cancer Therapy," Cancer Res, Jun. 15, 2009, 69(12):4941-4944. doi: 10.1158/0008-5472.CAN-09-0547. Epub Jun. 9, 2009.
Bardwell et al., "Potent and conditional redirected T cell killing of tumor cells using Half DVD-Ig," Protein Cell, Jan. 2018, 9(1):121-129.
Beljaars et al., "The preferential homing of a platelet derived growth factor receptor-recognizing macromolecule to fibroblast-like cells in fibrotic tissue," Biochemical Pharmacology, Oct. 2003, 66(7):1307-1317.
Berntzen et al., "Identification of a High Affinity FcγRIIA-binding Peptide that Distinguishes FcγRIIA from FcγRIIB and Exploits FcγRIIA-mediated Phagocytosis and Degradation," J Biol Chem, Jan. 2009, 284(2): 1126-1135. doi: 10.1074/jbc.M803584200. Epub Oct. 28, 2008.
Binetruy-Tournaire et al., "Identification of a peptide blocking vascular endothelial growth factor (VEGF)-mediated angiogenesis," EMBO J, Apr. 3, 2000, 19(7):1525-1533.
Boder et al., "Directed evolution of antibody fragments with monovalent femtomolar antigen binding affinity," Proc Natl Acad Sci USA, Sep. 26, 2000, 97(20):10701-10705.
Bostrom et al., "Variants of the Antibody Herceptin That Interact with HER2 and VEGF at the Antigen Binding Site," Science, Mar. 20, 2009, 323(5921):1610-1614.
Brennand et al., "A cyclic peptide analogue of loop III of PDGF-BB causes an apoptosis in human fibroblasts," FEBS Lett, Dec. 1997, 15, 419(2-3):166-170.
Bulman et al., "Mutations in the human Delta homologue, DLL3, cause axial skeletal defects in spondylocostal dysostosis," Nat Genet, Apr. 2000, 24(4):438-441.
Campoli et al., "Immunotherapy of Malignant Disease with Tumor Antigen-Specific Monoclonal Antibodies," Clin Cancer Res, Jan. 1, 2010, 16(1):11-20. Epub Dec. 22, 2009.
Chamarthy et al., "Gene delivery to dendritic cells facilitated by a tumor necrosis factor alpha-competing peptide," Mol Immunol, Jul. 2004, 41(8):741-749.
Chen et al., "Characterization of human IgG repertoires in an acute HIV-1 infection," Exp Mol Pathol, Dec. 2012, 93(3):399-407. doi: 10.1016/j.yexmp.2012.09.022. Epub Oct. 1, 2012.
Chen et al., "Enhancement and destruction of antibody function by somatic mutation: unequal occurrence is controlled by V gene combinatorial associations," The EMBO Journal, Jun. 1995, 14(12):2784-2794.
Conrad et al., "TCR and CD3 antibody cross-reactivity in 44 species," Cytometry A, Nov. 2007, 71(11):925-933.

(56) References Cited

OTHER PUBLICATIONS

Dall'Acqua et al., "Modulation of the Effector Functions of a Human IgG1 through Engineering of Its Hinge Region," J Immunol, Jul. 15, 2006, 177(2):1129-1138.
De Pascalis et al., "Grafting of 'Abbreviated' Complementarity-Determining Regions Containing Specificity-Determining Residues Essential for Ligand Contact to Engineer a Less Immunogenic Humanized Monoclonal Antibody," J Immunol, Sep. 15, 2002, 169(6):3076-3084.
Deambrosis et al., "Inhibition of CD40-CD154 costimulatory pathway by a cyclic peptide targeting CD154," J Mol Med, Feb. 2009, 87(2):181-197.
Dermer et al., "Another Anniversary for the War on Cancer," Bio/Technology, Mar. 12, 1994, 12:320.
Dickopf et al., "Format and geometries matter: Structure-based design defines the functionality of bispecific antibodies," Comput Struct Biotechnol J, May 14, 2020, 18:1221-1227.
Dreier et al., "Extremely Potent, Rapid and Costimulation-Independent Cytotoxic T-Cell Response Against Lymphoma Cells Catalyzed by a Single-Chain Bispecific Antibody," Int J Cancer, Aug. 20, 2002, 100(6):690-697.
Dufner, "Harnessing phage and ribosome display for antibody optimization," Trends Biotechnol, Nov. 2006, 24(11):523-529.
Eigenbrot et al., "Two-in-One antibodies with dual action Fabs," Curr Opin Chem Biol, Jun. 2013, 17(3):400-405. doi: 10.1016/j.cbpa.2013.04.015. Epub May 14, 2013.
Ellmark et al., "Selective FcγR engagement by human agonistic anti-CD40 antibodies," Transl Cancer Res, 2016, 5(Suppl 4):S839-S841.
Faham et al., "Antigen-Containing Liposomes Engrafted with Flagellin-Related Peptides Are Effective Vaccines That Can Induce Potent Antitumor Immunity and Immunotherapeutic Effect," J Immunol, Jul. 2010, 2010, 185:1744-1754.
Fukuda et al., "In vitro evolution of single-chain antibodies using mRNA display," Nucleic Acids Res, Nov. 2006, 34(19):e127, 8 pages.
Gura et al., "Systems for Identifying New Drugs Are Often Faulty," Science, Nov. 7, 1997, 278:1041-1042.
Hanes et al., "Picomolar affinity antibodies from a fully synthetic naïve library selected and evolved by ribosome display," Nat Biotechnol, Dec. 2000, 18(12):1287-1292.
Harvey et al., "Anchored periplasmic expression, a versatile technology for the isolation of high-affinity antibodies from *Escherichia coli*-expressed libraries," Proc Natl Acad Sci USA, Jun. 22, 2004, 101(25):9193-9198.
Hawkins et al., "Selection of Phage Antibodies by Binding Affinity—Mimicking Affinity Maturation," J Mol Biol, Aug. 5, 1992, 226(3):889-896.
Hetian et al., "A Novel Peptide Isolated from a Phage Display Library Inhibits Tumor Growth and Metastasis by Blocking the Binding of Vascular Endothelial Growth Factor to Its Kinase Domain Receptor," J Biol Chem, Nov. 8, 2002, 277(45):43137-43142.
Hezareh et al., "Effector Function Activities of a Panel of Mutants of a Broadly Neutralizing Antibody against Human Immunodeficiency Virus Type 1," J Virol, Dec. 2001, 75(24):12161-12168.
Holen et al., "Activation of EphA receptors on CD47CD45R07 memory cells stimulates migration," J Leukoc Biol, Jun. 2010, 87(6):1059-1068. doi: 10.1189/j1b.0709497. Epub Feb. 16, 2010.
Ikuta et al., "Expression of human immunodeficiency virus type 1 (HIV-1) gag antigens on the surface of a cell line persistently infected with HIV-1 that highly expresses HIV-1 antigens," Virology, Jun. 1989, 170(2):408-417.
Kraft et al., "Definition of an Unexpected Ligand Recognition Motif for αvβ6 Integrin," J Biol Chem, Jan. 22, 1999, 274:1979-1985.
Kramer et al., "Molecular basis for the binding promiscuity of an anti-p24 (HIV-1) monoclonal antibody" Cell, Dec. 12, 1997, 91(6):799-809.
Kronqvist et al., "A novel affinity protein selection system based on staphylococcal cell surface display and flow cytometry," Protein Eng Des Sel, Apr. 2008, 21(4):247-255.
Kussie et al., "A Single Engineered Amino Acid Substitution Changes Antibody Fine Specificity," J Immunol, Jan. 1, 1994, 152(1):146-152.
Lederman et al., "A Single Amino Acid Substitution in a Common African Allele of the CD4 Molecule Ablates Binding of the Monoclonal Antibody, OKT4," Mol Immunol, Nov. 1991, 28(11):1171-1181.
Li et al., "β-Endorphin omission analogs: Dissociation of immunoreactivity from other biological activities," Proc Natl Acad Sci USA, 1980, 77:3211-3214.
Li et al., Activation of the Proapoptotic Death Receptor DR5 by Oligomeric Peptide and Antibody Agonists, J Mol Biol, Aug. 18, 2006, 361(3):522-536.
Lightfield et al., "Critical function for Naip5 in inflammasome activation by a conserved carboxy-terminal domain of flagellin," Nat Immunol, Oct. 2008, 9(10):1171-1178. doi: 10.1038/ni.1646. Epub Aug. 24, 2008.
Lum et al., "Targeting T Cells with Bispecific Antibodies for Cancer Therapy," BioDrugs, Dec. 1, 2011, 25(6):365-379. doi:10.2165/11595950-000000000-00000.
Lutterbuese et al., "T cell-engaging BiTE antibodies specific for EGFR potently eliminate KRAS- and BRAF-mutated colorectal cancer cells," Pro Natl Acad Sci USA, Jul. 13, 2010, 107(28):12605-12610. doi: 10.1073/pnas.1000976107. Epub Jun. 28, 2010.
MacCallum et al., "Antibody-antigen Interactions: Contact Analysis and Binding Site Topography," J Mol Biol, Oct. 11, 1996, 262(5):732-745.
Mack et al., "A small bispecific antibody construct expressed as a functional single-chain molecule with high tumor cell cytotoxicity," Proc Natl Acad Sci USA, Jul. 18, 1995, 92(15):7021-7025.
Marks et al., "By-passing Immunization—Human Antibodies from V-gene Libraries Displayed on Phage," J Mol Biol, Dec. 5, 1991, 222(3):581-597.
Mezzanzanica et al., "Human Ovarian Carcinoma Lysis by Cytotoxic T Cells Targeted by Bispecific Monoclonal Antibodies: Analysis of the Antibody Components," Int J Cancer, Apr. 15, 1988, 41(4):609-615.
Mullendore et al., "Ligand-dependent Notch Signaling is Involved in Tumor Initiation and Tumor Maintenance in Pancreatic Cancer," Clin Cancer Res, Apr. 1, 2009, 15(7):2291-2301.
Nakamura et al., "Peptide mimics of epidermal growth factor (EGF) with antagonistic activity," Journal of Biotechnology, Mar. 30, 2005, 116(3): 211-219.
Odegrip et al., "CIS display: In vitro selection of peptides from libraries of protein-DNA complexes," Proc Natl Acad Sci USA, Mar. 2, 2004, 101(9):2806-2810.
Phillips et al., "Molecular subclasses of high-grade glioma predict prognosis, delineate a pattern of disease progression, and resemble stages in neurogenesis," Cancer Cell, Mar. 2006, 9(3):157-173.
Rao et al., "Novel cyclic and linear oligopeptides that bind to integrin β1 chain and either inhibit or costimulate T lymphocytes," Int Immunopharmacol, Mar. 2003, 3(3):435-443.
Richards et al., "A peptide containing a novel FPGN CD40-binding sequence enhances adenoviral infection of murine and human dendritic cells," Eur J Biochem, May 2003, 270(10):2287-2294.
Rudikoff et al., "Single amino acid substitution altering antigen-binding specificity," Proc Natl Acad Sci USA, Mar. 1982, 79(6):1979-1983.
Schaefer et al., "A two-in-one antibody against HER3 and EGFR has superior inhibitory activity compared with monospecific antibodies," Cancer Cell, Oct. 18, 2011, 20(4):472-486. doi: 10.1016/j.ccr.2011.09.003.
Schlereth et al., "T-cell activation and B-cell depletion in chimpanzees treated with a bispecific anti-CD19/anti-CD3 single-chain antibody construct," Cancer Immunol Immunother, May 2006, 55(5):503-514. Epub Jul. 20, 2005.
Schraa et al., RGD-Modified Anti-CD3 Antibodies Redirect Cytolytic Capacity of Cytotoxic T Lymphocytes Toward αvβ3-Expressing Endothelial Cells, Int J Cancer, Nov. 1, 2004, 112(2):279-285.

(56) References Cited

OTHER PUBLICATIONS

Sebastian et al., "Treatment of non-small cell lung cancer patients with the trifunctional monoclonal antibody catumaxomab (anti-EpCAM x anti-CD3): a phase I study," Cancer Immunol Immunother, Oct. 2007, 56(10):1637-1644. Epub Apr. 5, 2007.
Sepp et al., "Cell-Free Selection of Domain Antibodies by in vitro Compartmentalization," Methods Mol Biol, Jul. 2012, 911:183-198.
Shanmugam et al., "Synthetic Toll Like Receptor-4 (TLR-4) Agonist Peptides as a Novel Class of Adjuvants," PLoS One, Feb. 2012, 7(2):e30839.
Staerz et al., "Hybrid antibodies can target sites for attack by T cells," Nature, Apr. 18-24, 1985, 314(6012):628-631.
Staerz et al., "Hybrid hybridoma producing a bispecific monoclonal antibody that can focus effector T-cell activity," Proc Natl Acad Sci USA, Mar. 1986, 83(5):1453-1457.
Stancovski et al., "Mechanistic Aspects of the Opposing Effects of Monoclonal Antibodies to the ERBB2 Receptor on Tumor Growth," Proc Nat Acad Sci USA, Oct. 1, 1991, 88(19):8691-8695.
Traxlmayr et al., "Integrin binding human antibody constant domains—Probing the C-terminal structural loops for grafting the RGD motif," J Biotechnol, Sep. 10, 2011, 155(2):193-202. doi: 10.1016/j.jbiotec.2011.06.042. Epub Jul. 8, 2011.
Turnpenny et al., "Novel mutations in DLL3, a somitogenesis gene encoding a ligand for the Notch signaling pathway, cause a consistent pattern of abnormal vertebral segmentation in spondylocostal dysostosis," J Med Genet, May 2003, 40(5):333-339.
Tutt et al., "Trispecific F(ab')3 derivatives that use cooperative signaling via the TCR/CD3 complex and CD2 to activate and redirect resting cytotoxic T cells," J Immunol, Jul. 1, 1991, 147(1):60-69.
Vajdos et al., "Comprehensive Functional Maps of the Antigen-binding Site of an Anti-ErbB2 Antibody Obtained with Shotgun Scanning Mutagenesis," J Mol Biol, Jul. 5, 2002, 320(2):415-428.
Vaughan et al., "Human Antibodies with Sub-nanomolar Affinities Isolated from a Large Non-immunized Phage Display Library," Nat Biotechnol, Mar. 1996, 14(3):309-314.
Witte et al., "Monoclonal antibodies targeting the VEGF receptor-2 (Flk1/KDR) as an anti-angiogenic therapeutic strategy," Cancer and Metastasis Reviews, Jun. 1998, 17(2):155-161.
Wolf et al., "BiTEs: bispecific antibody constructs with unique anti-tumor activity," Drug Discov Today, Sep. 15, 2005, 10(18):1237-1244.
Wu et al., "Humanization of a Murine Monoclonal Antibody by Simultaneous Optimization of Framework and CDR Residues," J Mol Biol, Nov. 19, 1999, 294(1):151-162.
Wu et al., "Structures of the CXCR4 Chemokine GPCR with Small-Molecule and Cyclic Peptide Antagonists," Science, Nov. 19, 2010, 330:1066-1071.
Yu et al., "Interaction between Bevacizumab and Murine VEGF-A: A Reassessment," Investigative Ophthalmology and Visual Science, Feb. 2008, 49(2):522-527.
Zhou et al., "Development of a novel mammalian cell surface antibody display platform," mAbs, Sep.-Oct. 2010, 2(5):508-518.
U.S. Appl. No. 17/914,432, Chichili et al., filed Sep. 26, 2022.
U.S. Appl. No. 17/914,432, filed Sep. 26, 2022 Chichili et al.
Garber et al., "Bispecific antibodies rise again," Nat Rev Drug Discov, Nov. 2014, 13(11):799-801.
Chiu et al., "Antibody Structure and Function: The Basis for Engineering Therapeutics," Antibodies, 2019, 8(55):1-80.
Diamond et al., "Somatic mutation of the T15 heavy chain gives rise to an antibody with autoantibody specificity," Proc Natl Acad Sci USA, Sep. 1984, 81(18):5841-5844.
Dirks, "Brain tumor stem cells: bringing order to the chaos of brain cancer," J Clin Oncol, Jun. 10, 2008, 26(17):2916-2924.
Kuznetsova, "Brackets in text of legal document as a linguo-cognitive phenomenon," Bulletin MGOU, Chapter—Russian Philology, 2015, 3:37-43 (with English translation).
Lopez-Lazaro et al., "The migration ability of stem cells can explain the existence of cancer of unknown primary site. Rethinking metastasis," Oncoscience, May 1, 2015, 2(5):467-475.
Mabey, "Epidemiology of sexually transmitted infections: worldwide," Medicine, 2014, 42(6):287-290.
Mariuzza et al., "The Structural Basis of Antigen-Antibody Recognition," Annu Rev Biophys Biophys Chem, 1987, 16:139-159.
Ohno et al., "Antigen-binding specificities of antibodies are primarily determined by seven residues of $V_H$," Proc Natl Acad Sci USA, May 1985, 82(9):2945-2949.
Roitt et al., "Antibody Structure and Function," Immunology, Moscow, Mir, 2000, pp. 110-111 (with what are believed to be the corresponding pages from an English version of Immunology).
Rudzitis et al., Chemistry—Inorganic chemistry—8th grade, 2011, p. 15 (with English translation).
Singer et al., "The Genetic Molecules," Genes & Genomes, Moscow, Mir, 1998, pp. 63-64 (with what are believed to be the corresponding pages from an English version of Genes & Genomes).
Solopova et al., "Bispecific Antibodies in Clinical Practice and Clinical Trials (Literature Review)," Clinical Oncohematology, 2019, 12(2):125-144 (with English translation).
Sundberg, "Structural basis of antibody-antigen interactions," Methods Mol Biol, 2009, 524:23-36.
Torres et al., "The immunoglobulin constant region contributes to affinity and specificity," Trends Immunol, Feb. 2008, 29(2):91-97. doi: 10.1016/j.it.2007.11.004. Epub Jan. 10, 2008. PMID: 18191616.
Tran et al., "Survival comparison between glioblastoma multiforme and other incurable cancers," J Clin Neurosci, Apr. 2010,17(4):417-421.
Yarilin, Fundamentals of Immunology, Moscow, Medicina, 1999, pp. 172-174 (with English translation).
Domingues et al., "Melanoma treatment in review," Immunotargets Ther, Jun. 7, 2018, 7:35-49.
Guselnikova et al., "NeuN as a Neuronal Nuclear Antigen and Neuron Differentiation Marker," Acta Naturae, 2015, 2(25):46-51 (with English translation).
Kadnikova et al., "Capsular Antigen of *Yersinia pestis*," Infection and Immunology, 2015, 5(3):201-218 (with English translation).
Tarantul, "Antigen," Explanatory Biotechnological Dictionary—Russian-English, Moscow, 2009, p. 66 (with English translation).
Wang et al., "Silence of MCL-1 upstream signaling by shRNA abrogates multiple myeloma growth," Exp Hematol Oncol, Nov. 19, 2014, 3(1):27, 7 pages.
Zajcev et al., "Prostate-specific antigen (PSA) in the diagnosis of prostate cancer," Polyclinics, 2012, 4-3:55-58 (with English abstract).
U.S. Appl. No. 17/670,917, Naoi et al., filed Feb. 14, 2022.
U.S. Appl. No. 17/670,917, filed Feb. 14, 2022, Naoi et al.
Liu et al., "Fine mapping of the antigen-antibody interaction of scFv215, a recombinant antibody inhibiting RNA polymerase II from *Drosophila melanogaster*," J Mol Recognit, Mar.-Apr. 1999, 12(2):103-111.
Wong et al., "Structural requirements for a specificity switch and for maintenance of affinity using mutational analysis of a phage-displayed anti-arsonate antibody of Fab heavy chain first complementarity-determining region," J Immunol, Jun. 15, 1998, 160(12):5990-5997.
U.S. Appl. No. 18/696,717, Naoi et al., filed Mar. 28, 2024.
U.S. Appl. No. 18/654,675, Naoi et al., filed May 3, 2024.
U.S. Appl. No. 18/696,717, filed Mar. 28, 2024, Naoi et al.
U.S. Appl. No. 18/654,675, filed May 3, 2024, Naoi et al.
Labrijn et al., "Bispecific antibodies: a mechanistic review of the pipeline," Nat Rev Drug Discov, Aug. 2019, 18(8):585-608.
Mikami et al., "Abstract 1872: A DLL3/CD3/CD137 trispecific T cell engager shows potent antitumor activity in small cell lung cancer models," Cancer Res, Apr. 4, 2023, 83(7_Supplement):1872, 1 page.
Rudin et al., "Emerging therapies targeting the delta-like ligand 3 (DLL3) in small cell lung cancer," J Hematol Oncol, Jun. 24, 2023, 16(1):66, 21 pages.
Wu et al., "Building blocks for bispecific and trispecific antibodies," Methods, Feb. 1, 2019, 154:3-9.
U.S. Appl. No. 17/914,855, filed Sep. 27, 2022, Naoi et al.
Grujic et al., "Impact of antibody subclass and disulfide isoform differences on the biological activity of CD200R and Bklotho agonist antibodies," Biochem Biophys Res Commun, May 13, 2017, 486(4):985-991.

(56) References Cited

OTHER PUBLICATIONS

Kirley et al., "Selective disulfide reduction for labeling and enhancement of Fab antibody fragments," Biochem Biophys Res Commun, Nov. 25, 2016, 480(4):752-757.
Moritz et al., "Assessment of disulfide and hinge modifications in monoclonal antibodies," Electrophoresis, Mar. 2017, 38(6):769-785.
Shen et al., "Single variable domain-IgG fusion. A novel recombinant approach to Fc domain-containing bispecific antibodies," J Biol Chem, Apr. 21, 2006, 281(16):10706-10714.
Vaks et al., "Design Principles for Bispecific IgGs, Opportunities and Pitfalls of Artificial Disulfide Bonds," Antibodies, Jul. 28, 2018, 7(3):27, 28 pages.
USPTO Final Office Action in U.S. Appl. No. 17/264,388, dated Aug. 1, 2024, 26 pages.
Chen et al., "Bispecific antibodies in cancer immunotherapy," Hum Vaccin Immunother, Oct. 2, 2016, 12(10):2491-2500. doi: 10.1080/21645515.2016.1187802. Epub Jun. 1, 2016.

* cited by examiner

[Fig. 1.1]
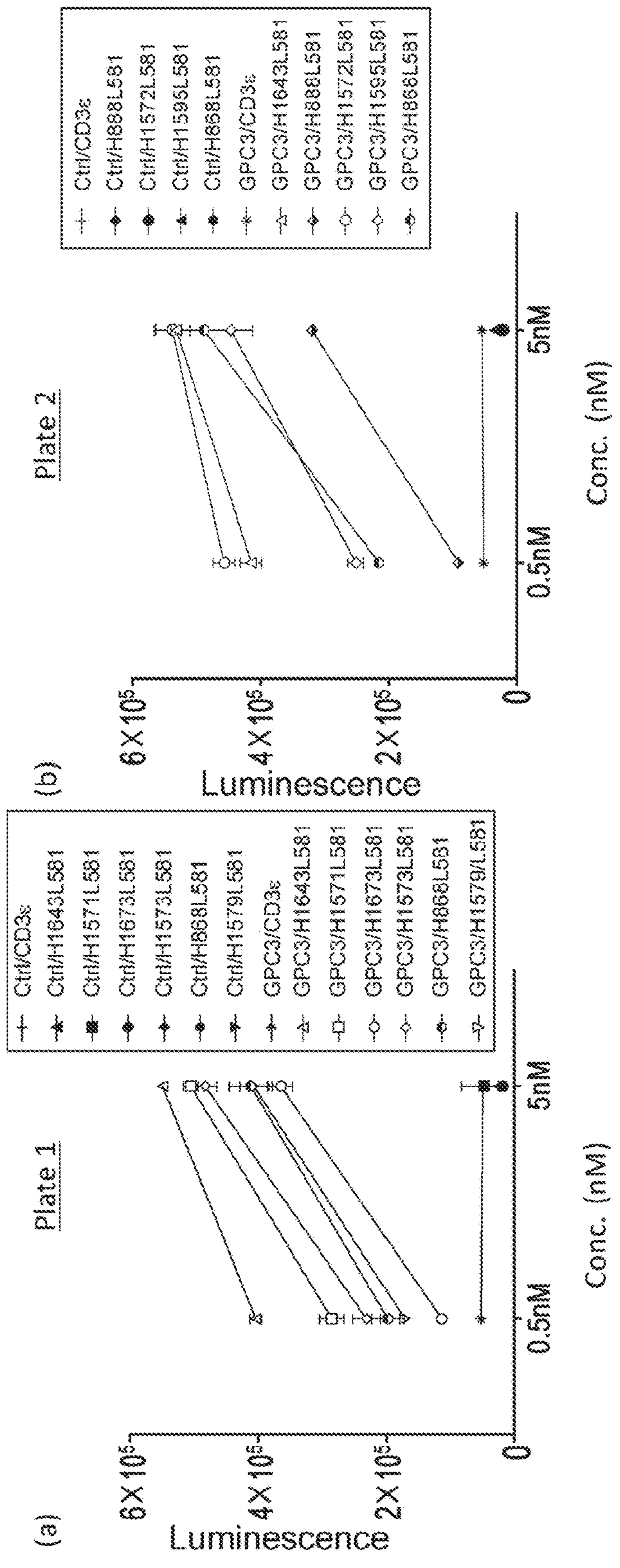

[Fig. 1.2]
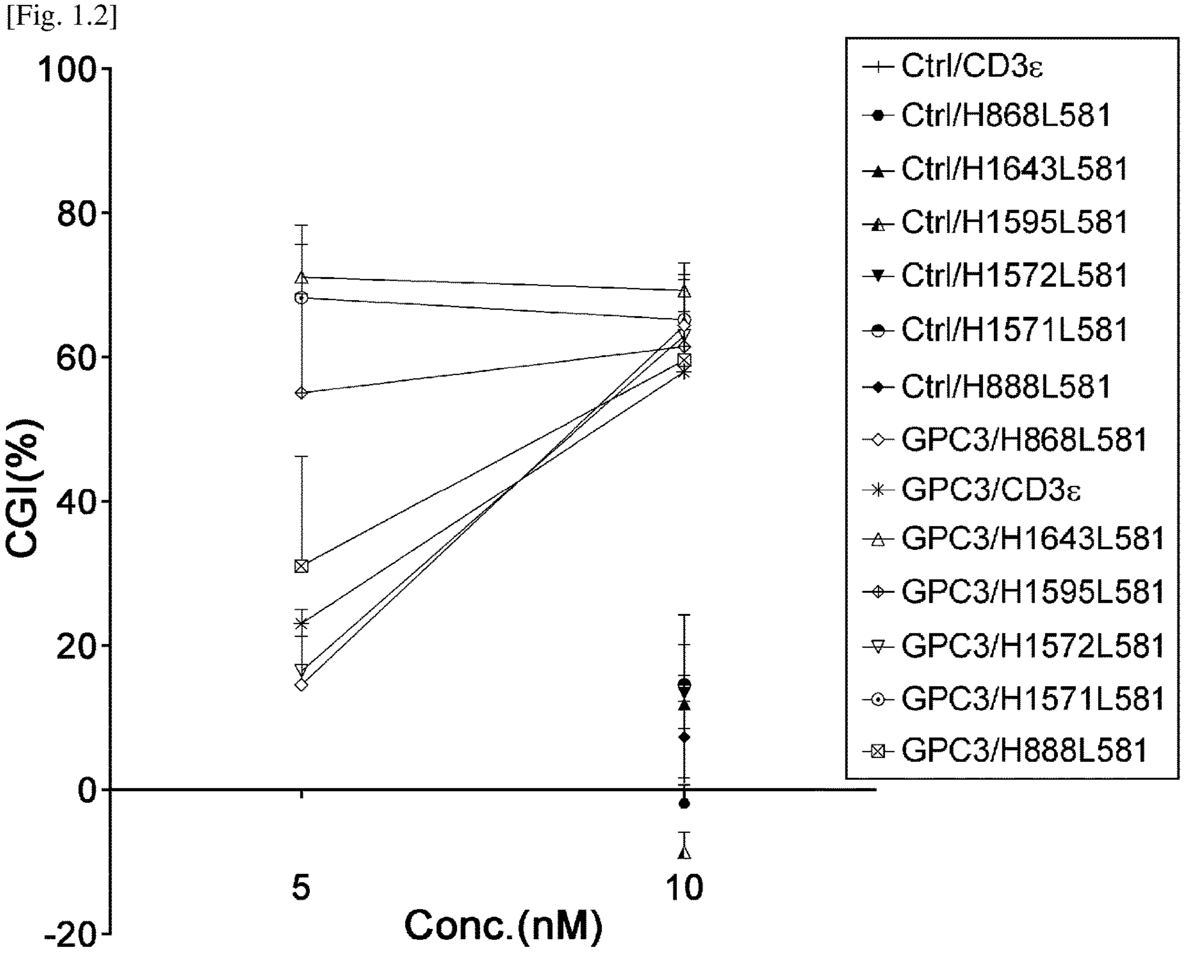

[Fig. 2.1]
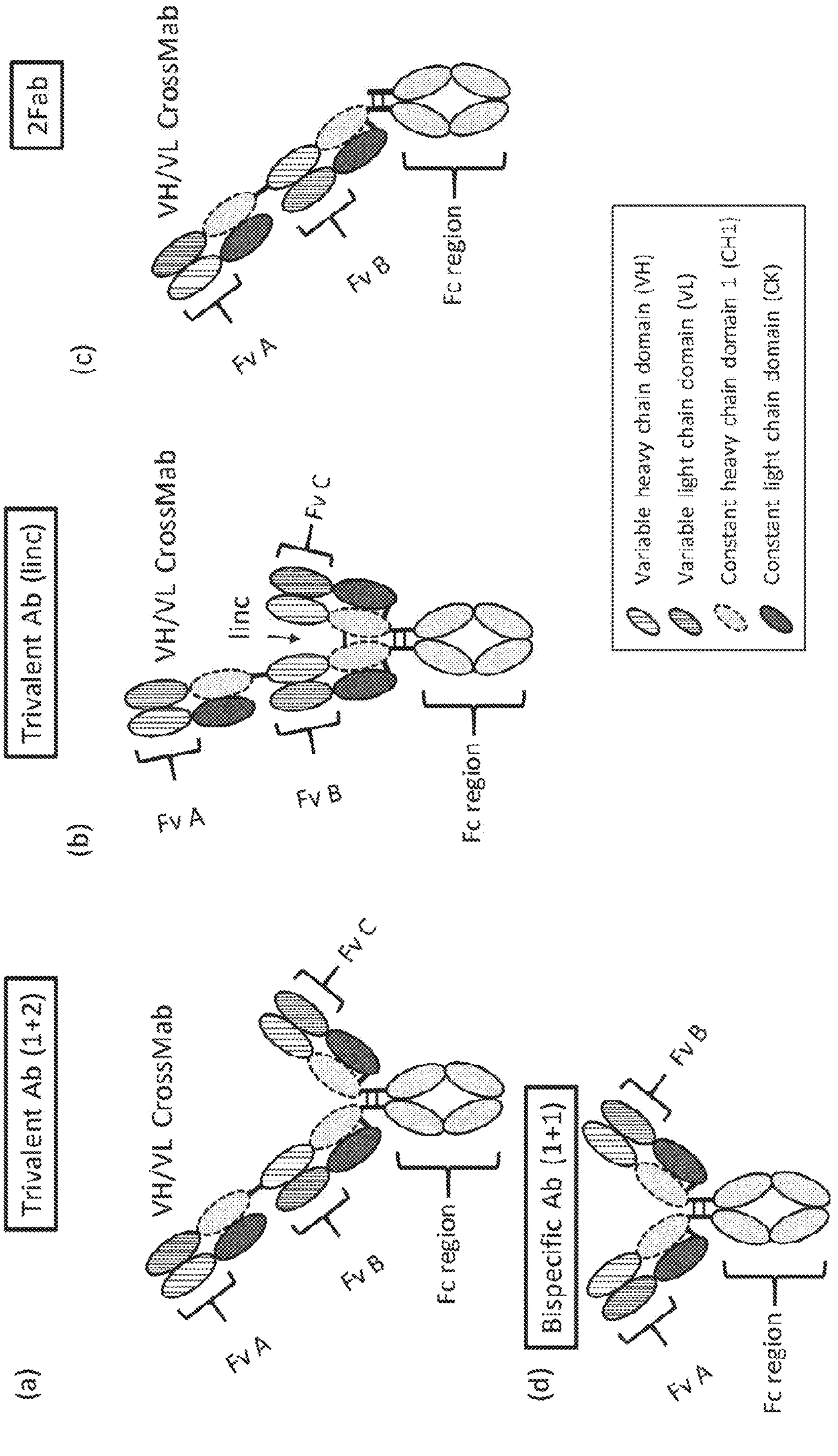

[Fig. 2.2.1]
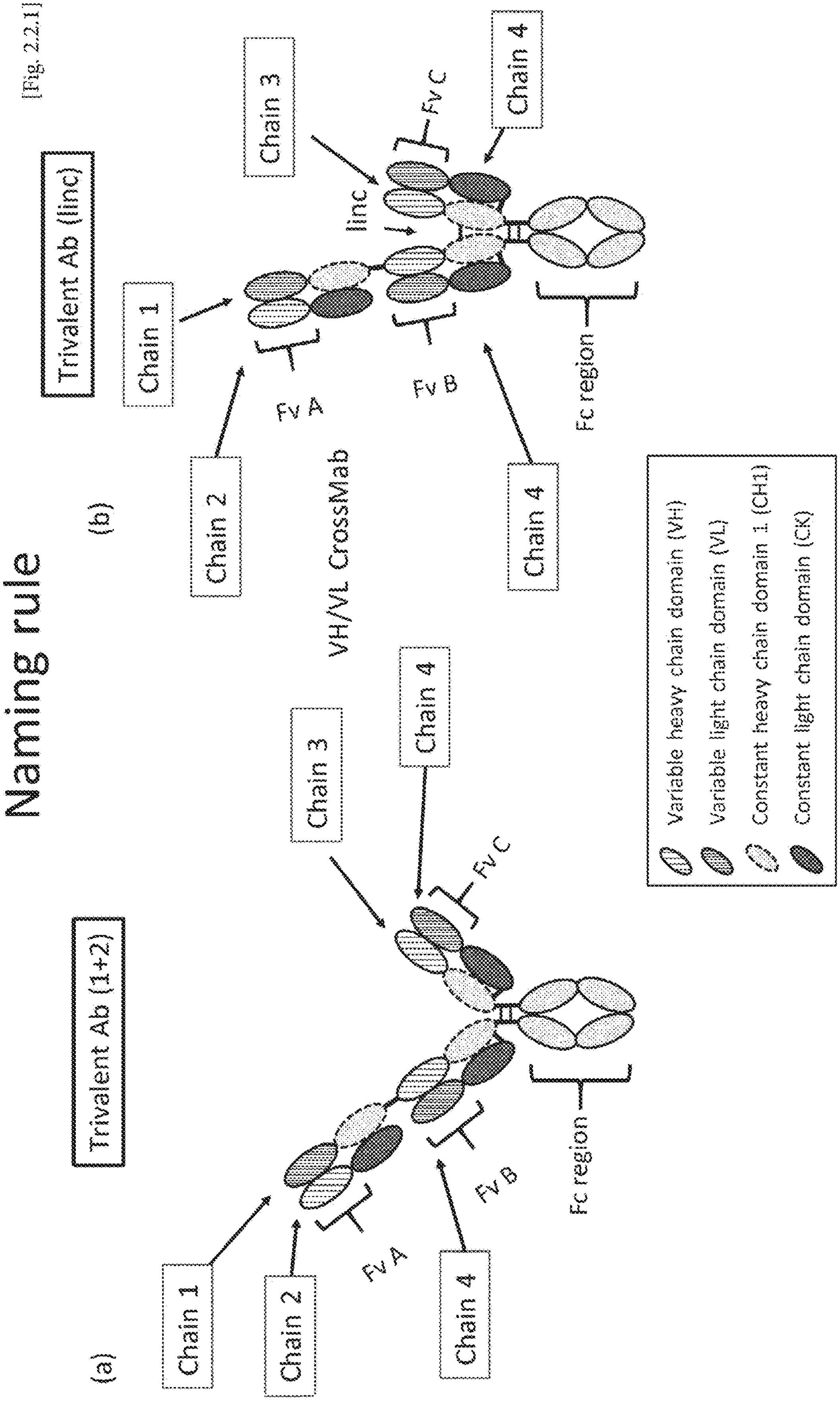

[Fig. 2.2.2]
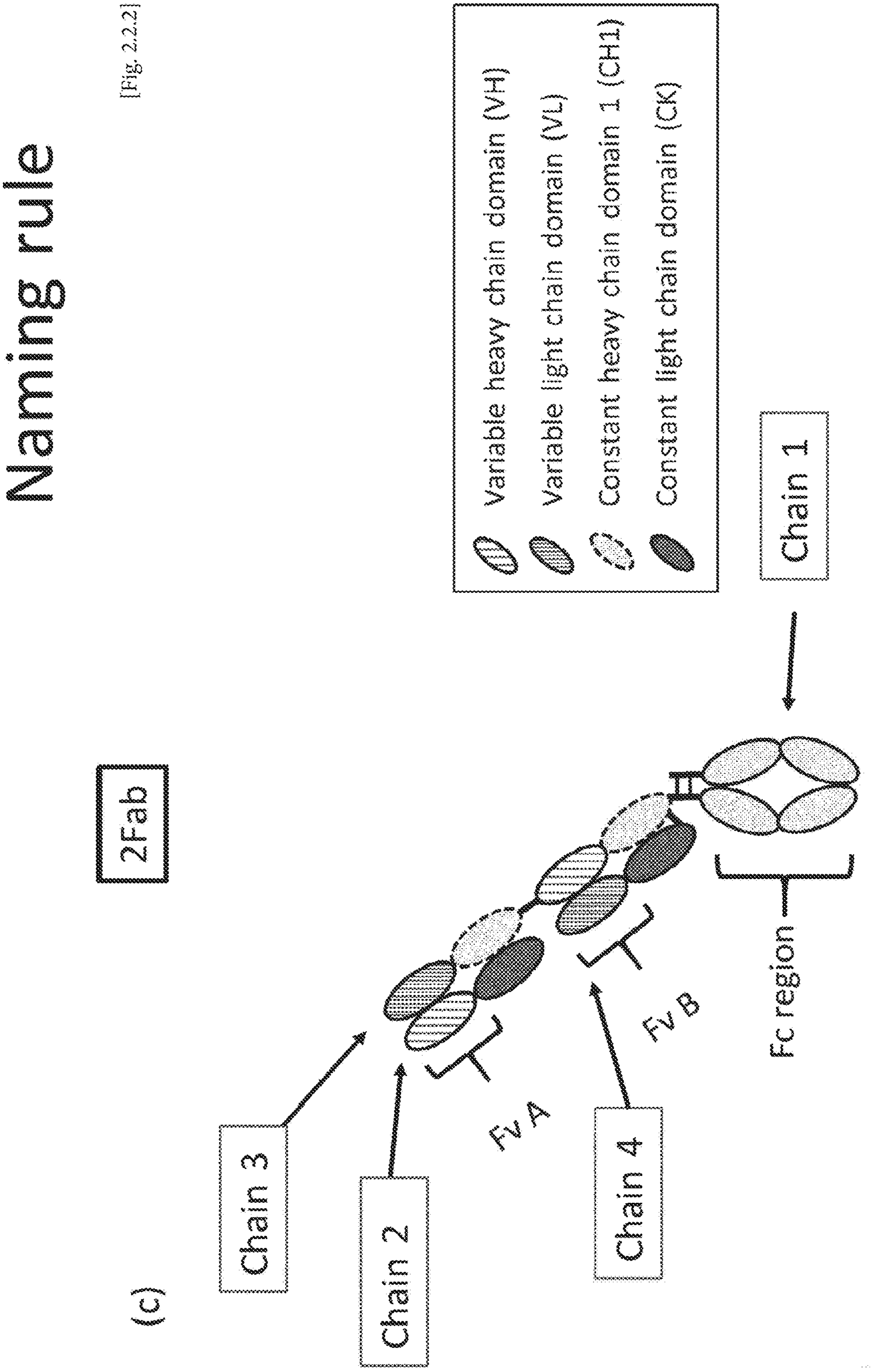

[Fig. 2.3]
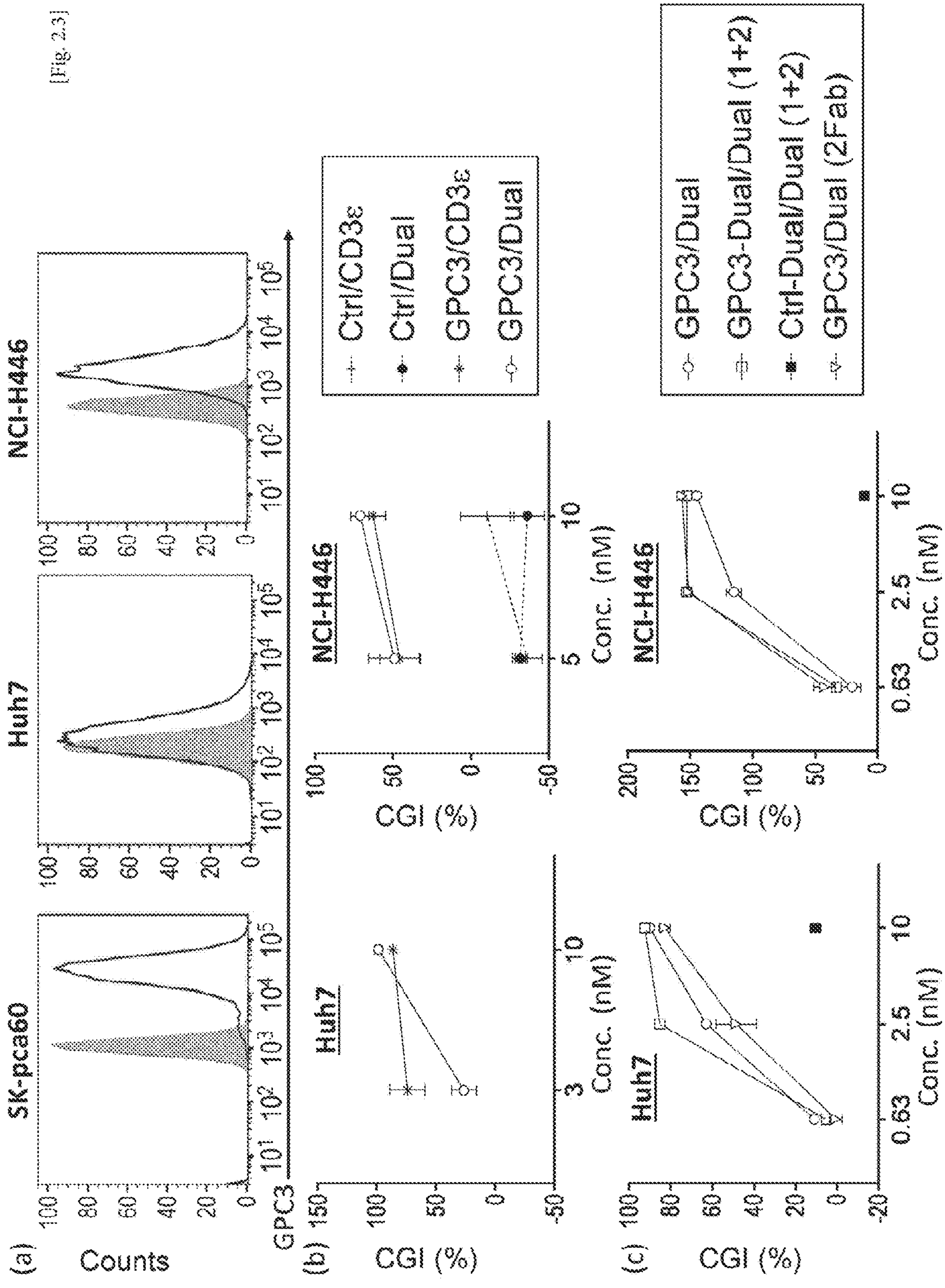

[Fig. 3.1]
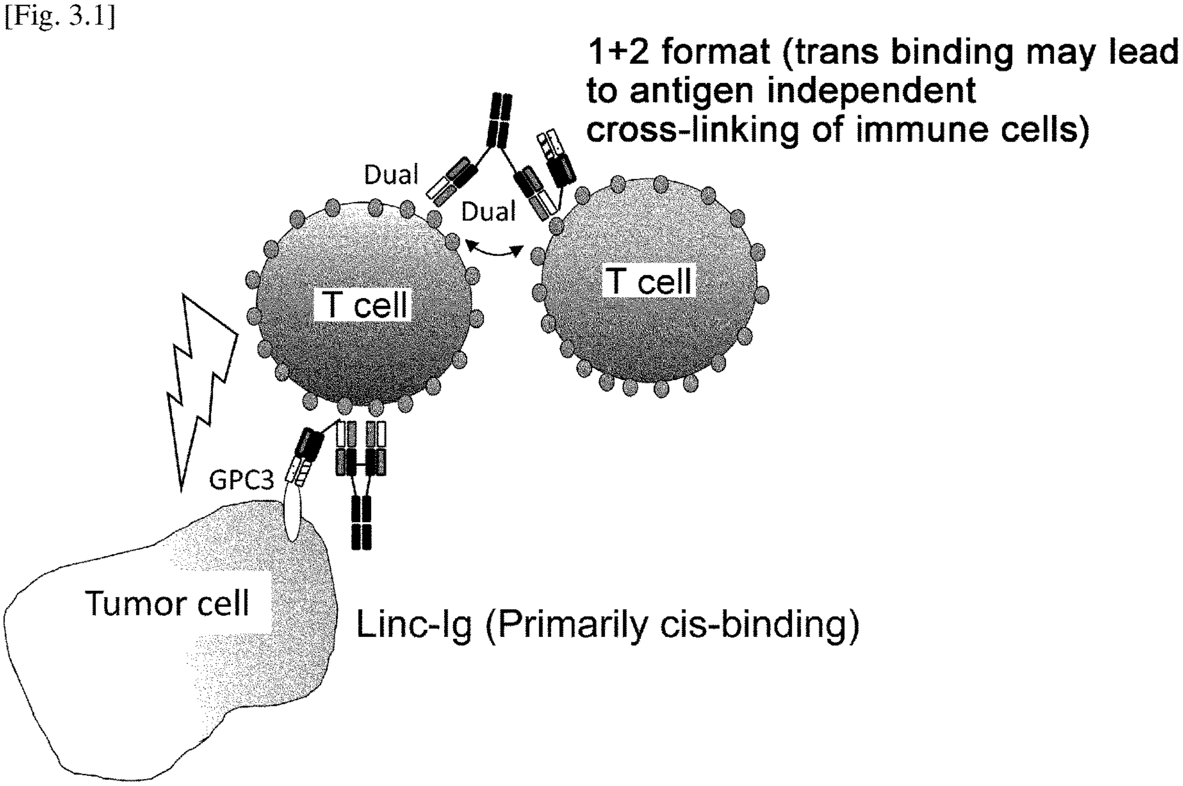
[Fig. 3.2]
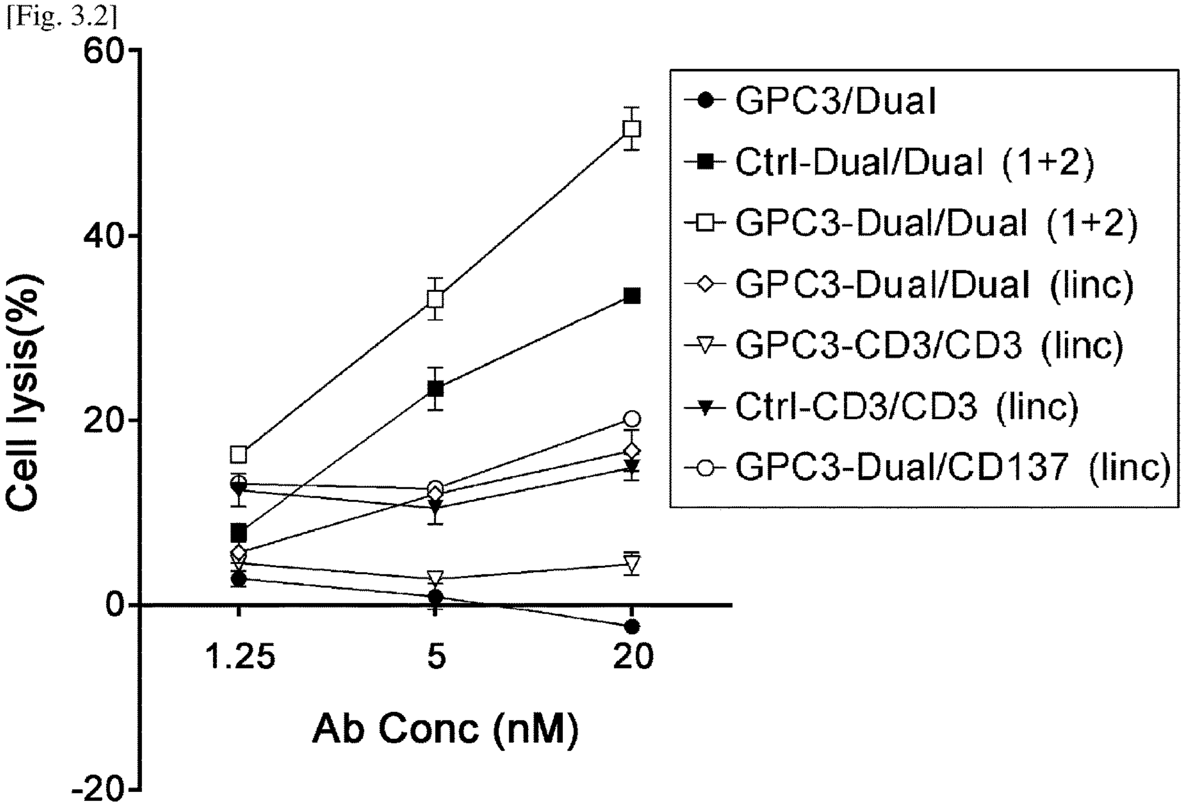

[Fig. 3.3]
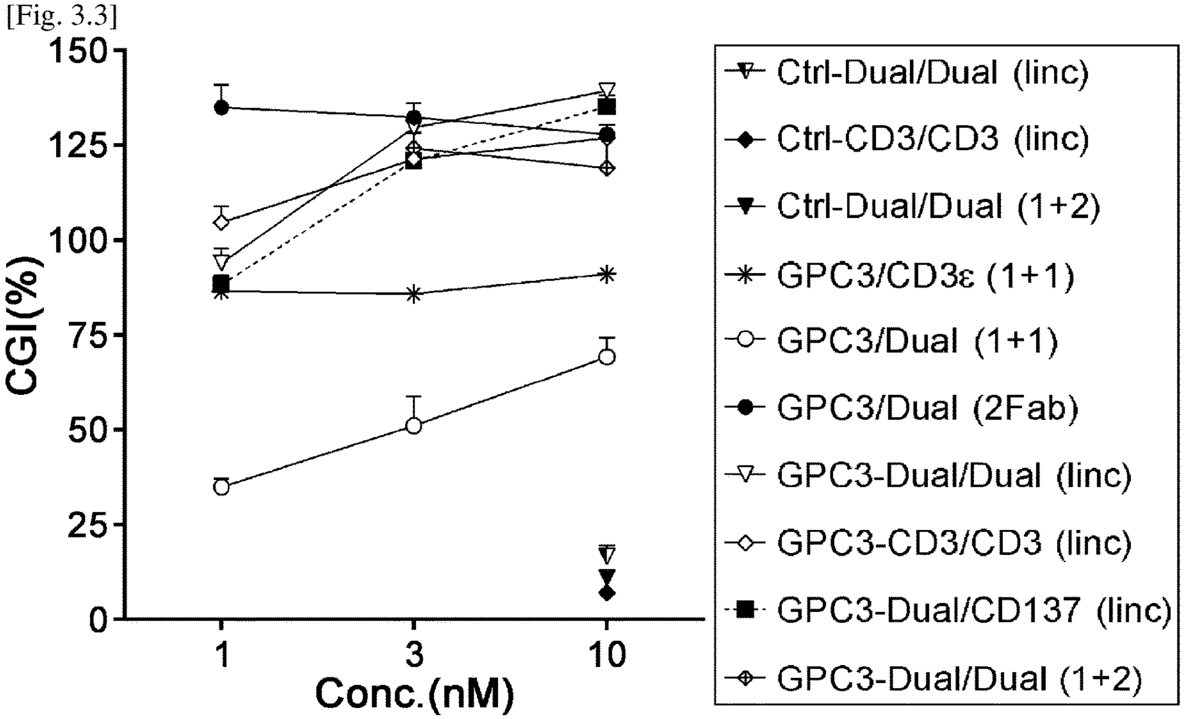

[Fig. 3.4]
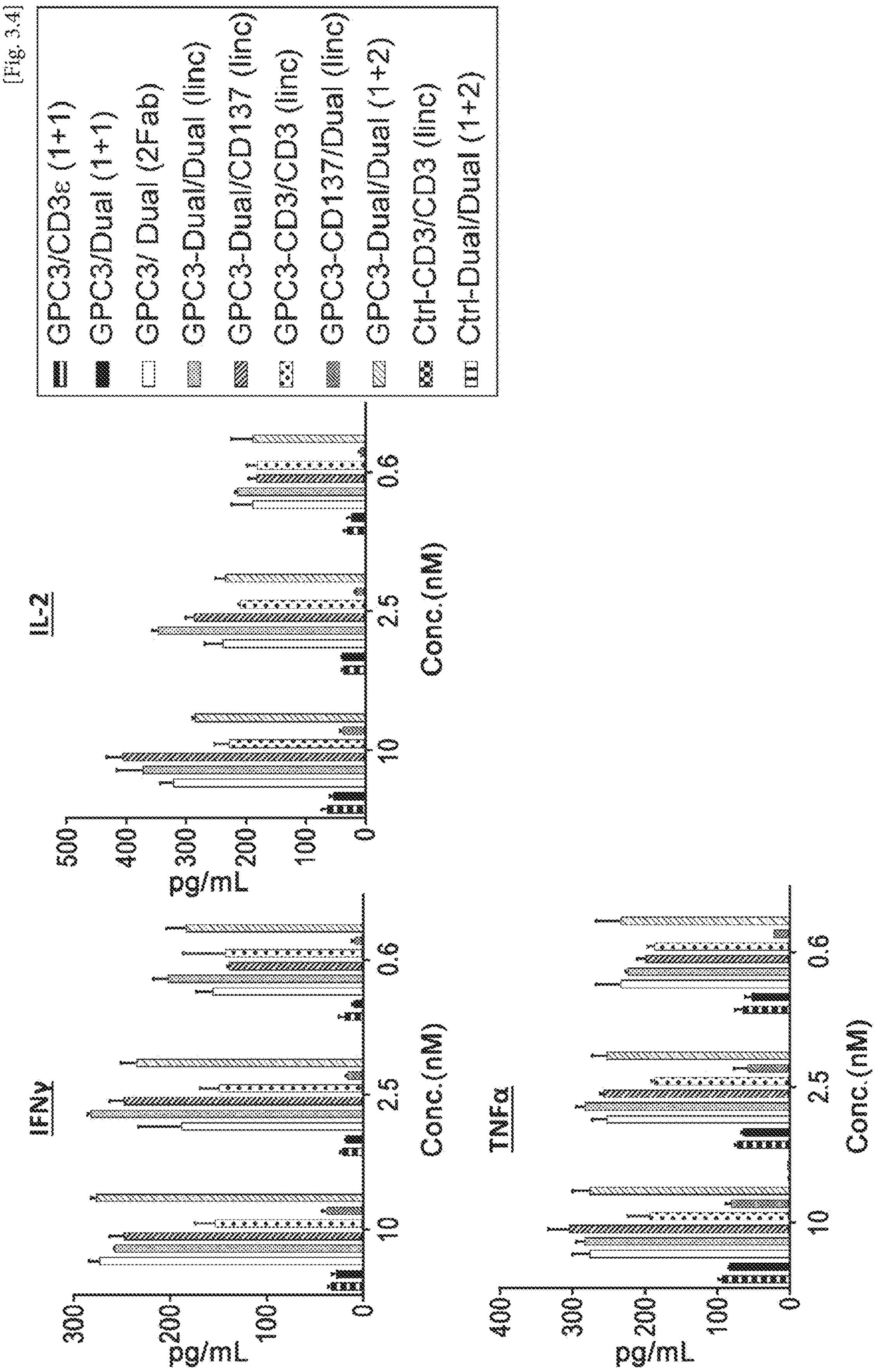

[Fig. 4]
C3NP1-27
Pyr-DGNEEMGGITQTPYKVSISGTTVILT-Cys (SEQ ID NO: 194)
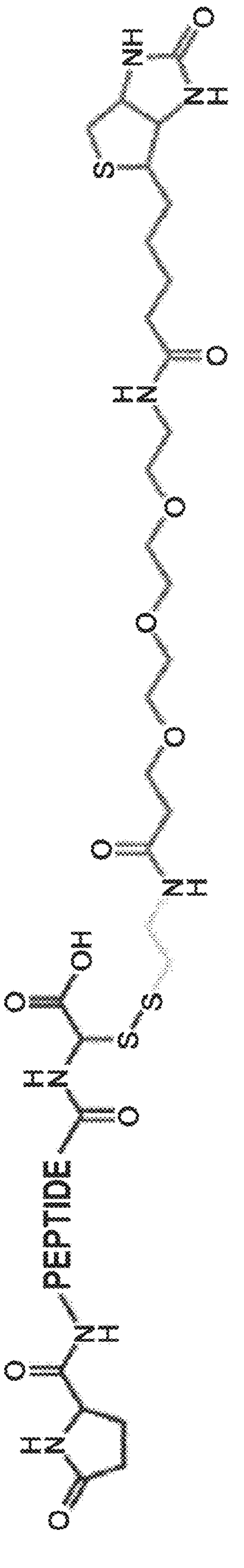

[Fig. 5]
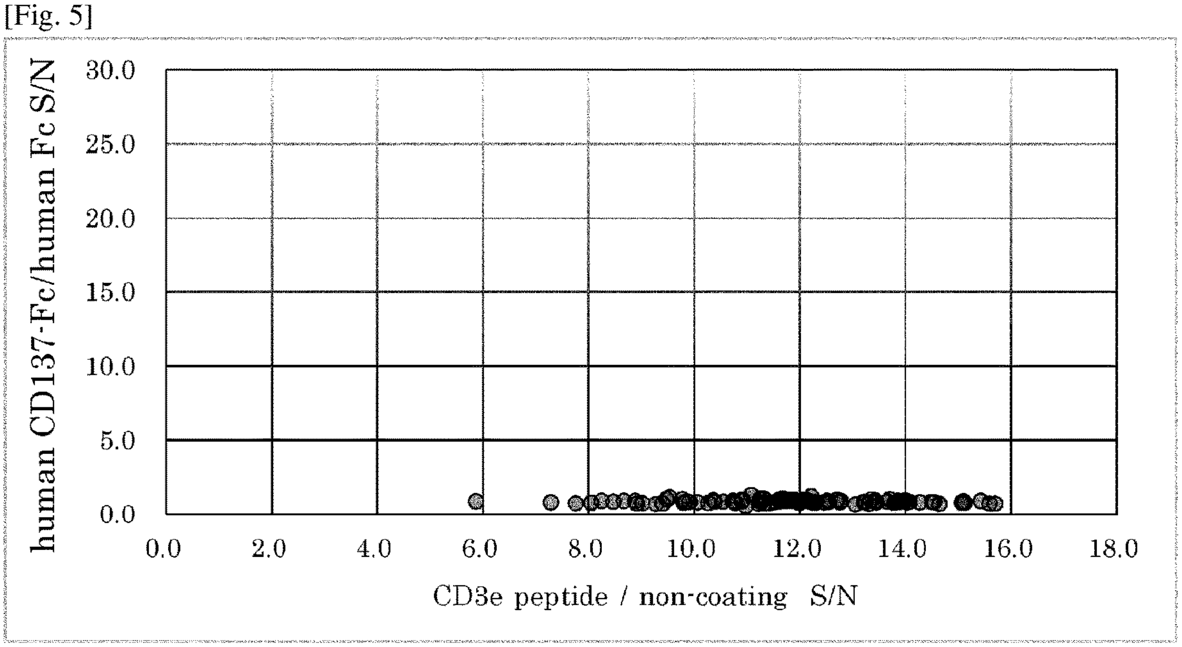
[Fig. 6]
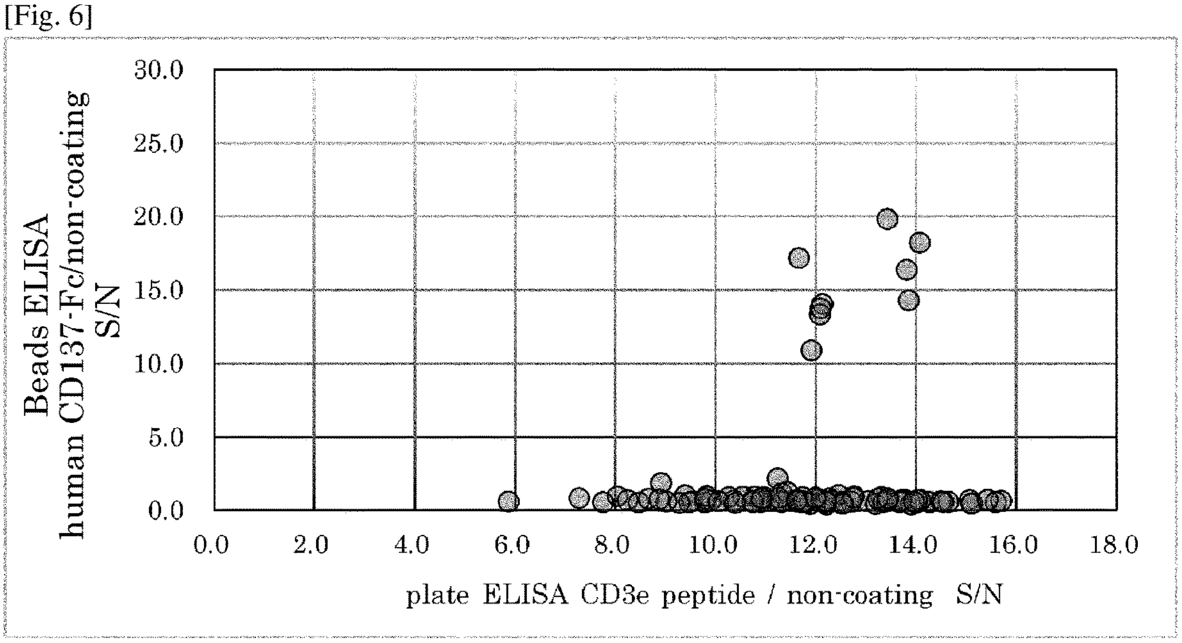

[Fig. 7]

```
cyCD137    1 LQDLCSNCPAGTFCDNNRSQICSPCPPNSFSSAGGQRTCDICRQCKGVFKTRKECSSTSN  60
huCD137    1 LQDPCSNCPAGTFCDNNRNQICSPCPPNSFSSAGGQRTCDICRQCKGVFRTRKECSSTSN  60

cyCD137   61 AECDCISGYHCLGAECSMCEQDCKQGQELTKKGCKDCCFGTFNDQKRGICRPWTNCSLDG 120
huCD137   61 AECDCTPGFHCLGAGCSMCEQDCKQGQELTKKGCKDCCFGTFNDQKRGICRPWTNCSLDG 120

cyCD137  121 KSVLVNGTKERDVVCGPSPADLSPGASSATPPAPAREPGHSPQ (SEQ ID NO : 92)  163
huCD137  121 KSVLVNGTKERDVVCGPSPADLSPGASSVTPPAPAREPGHSPQ (SEQ ID NO : 195) 163
```

[Fig. 8]
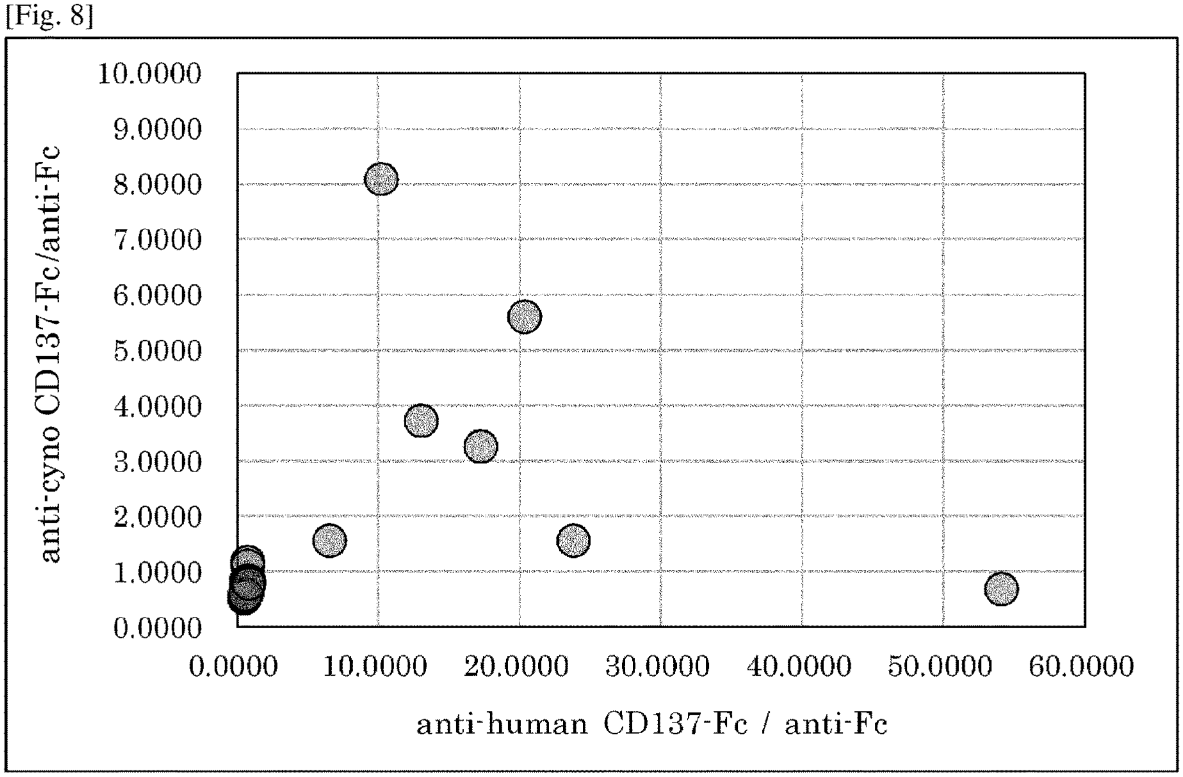
[Fig. 9]
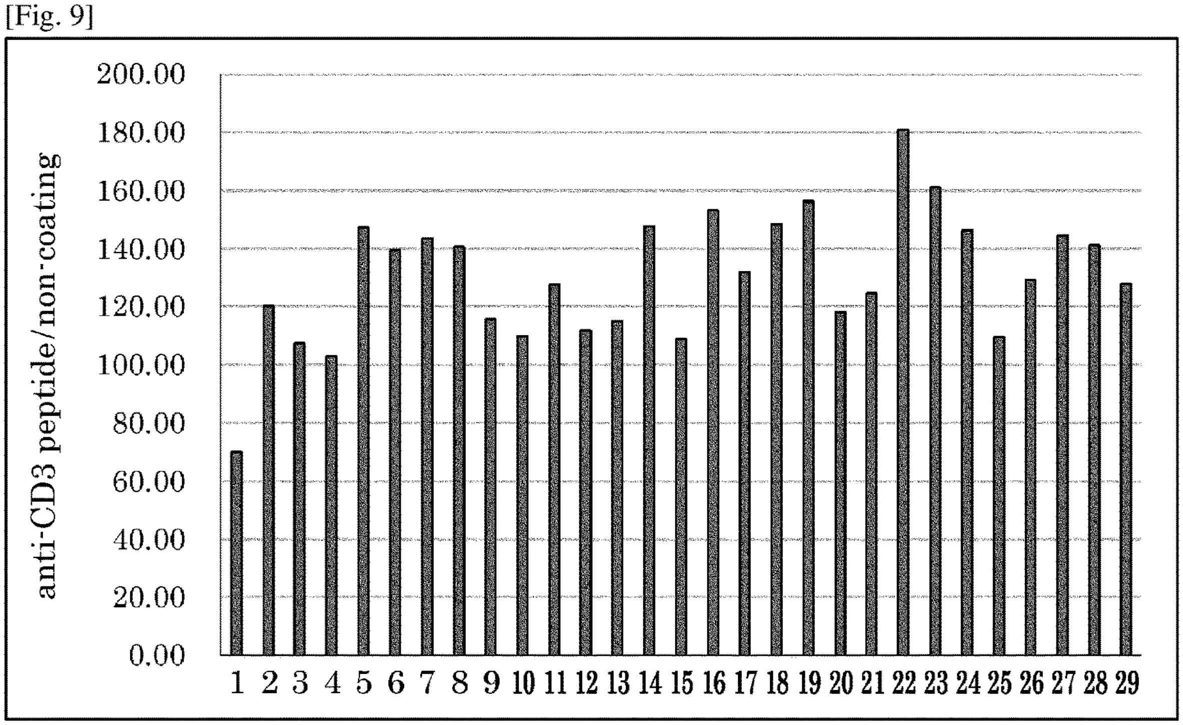

[Fig. 10]
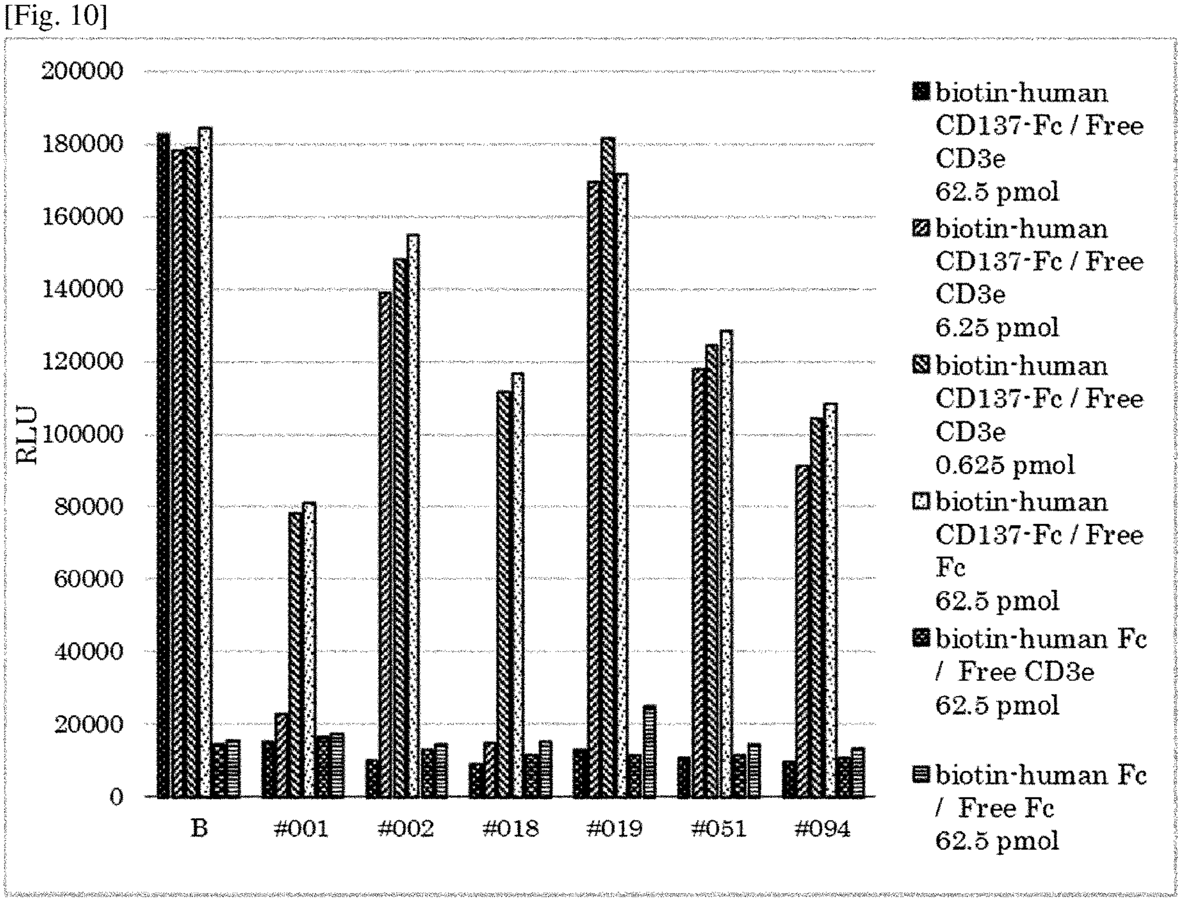
[Fig. 11A]
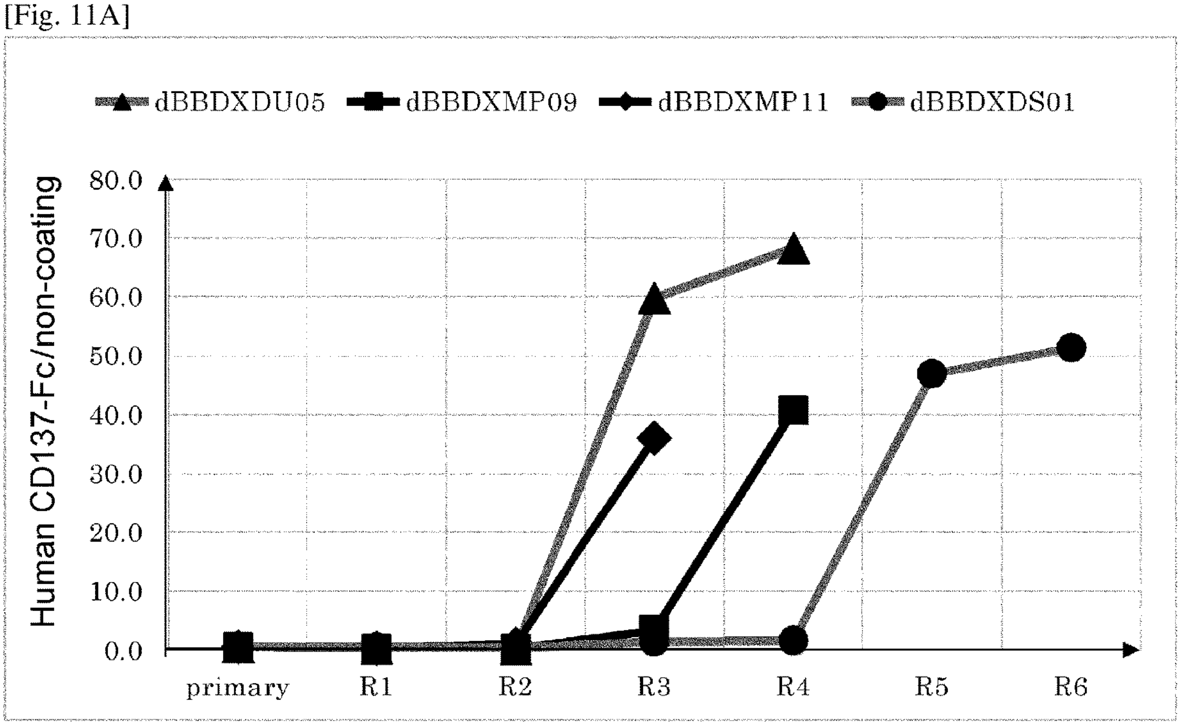

[Fig. 11B]
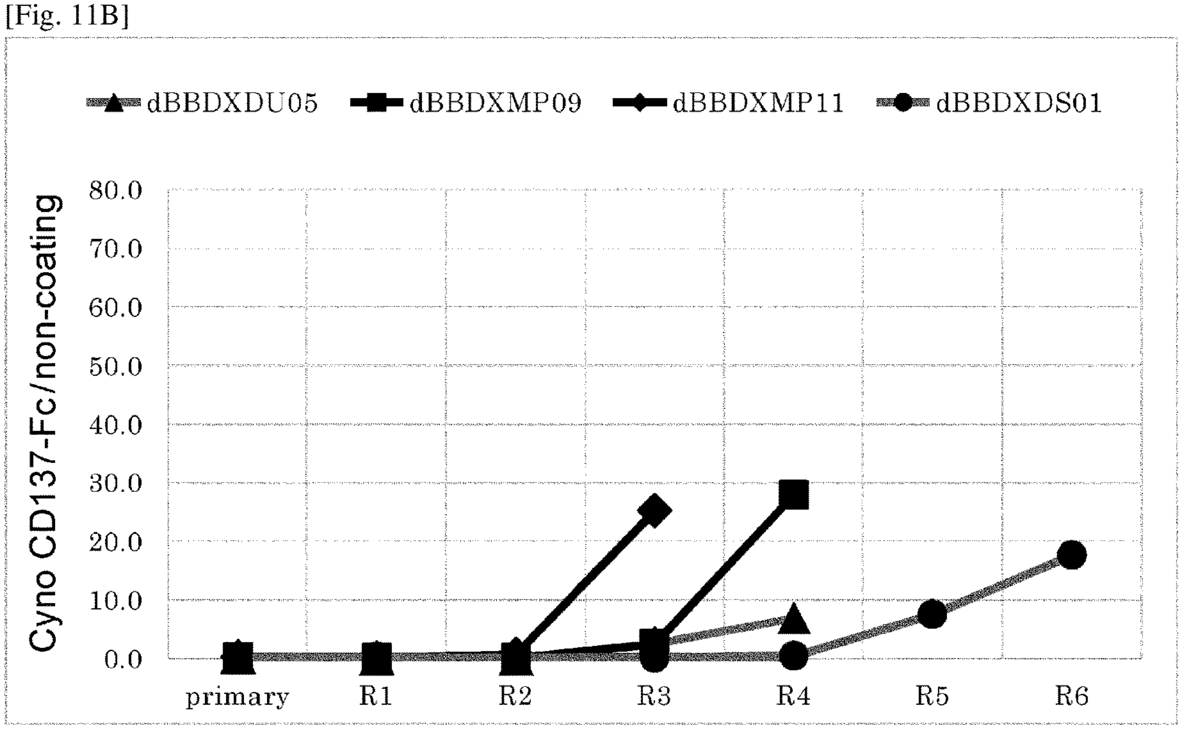
[Fig. 11C]
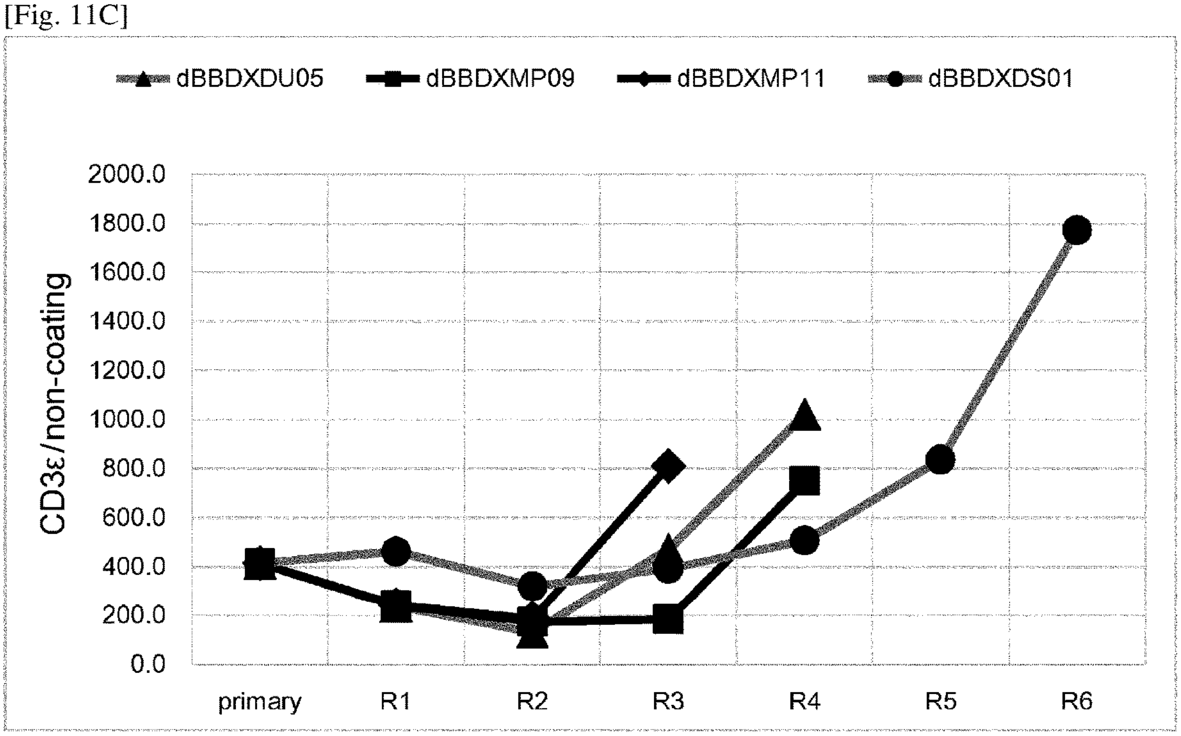

[Fig. 12.1]
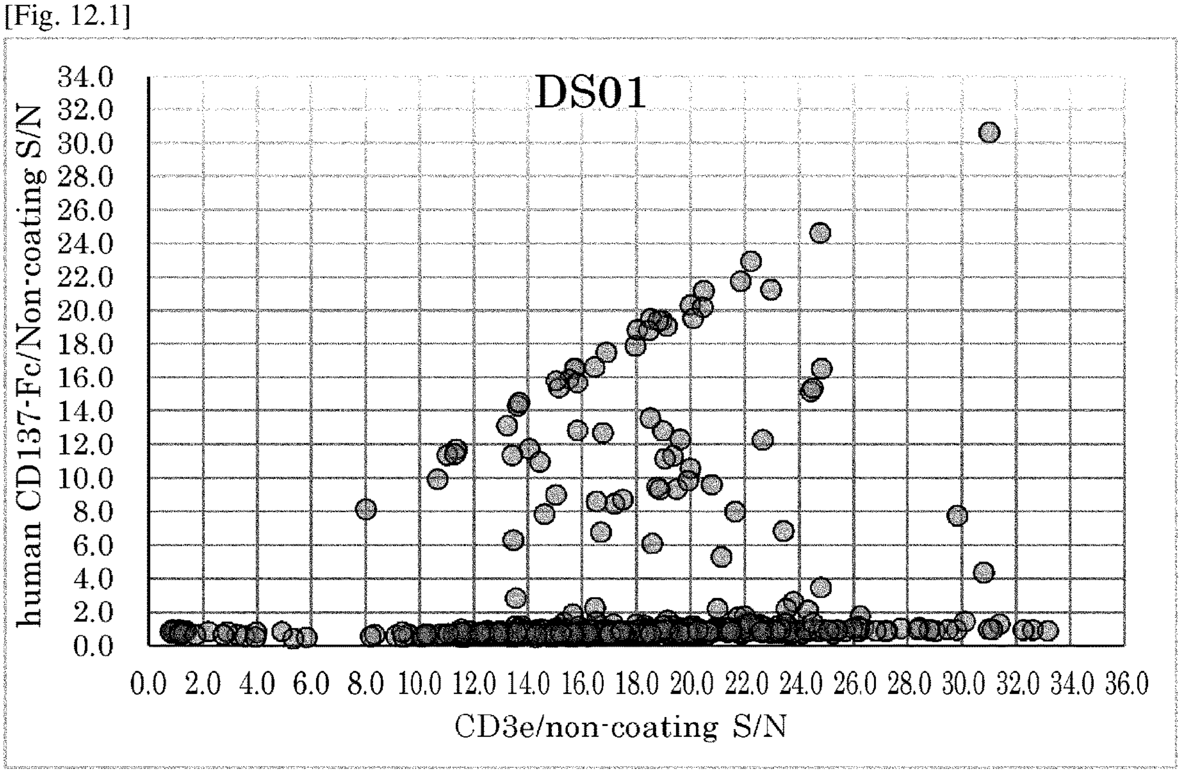
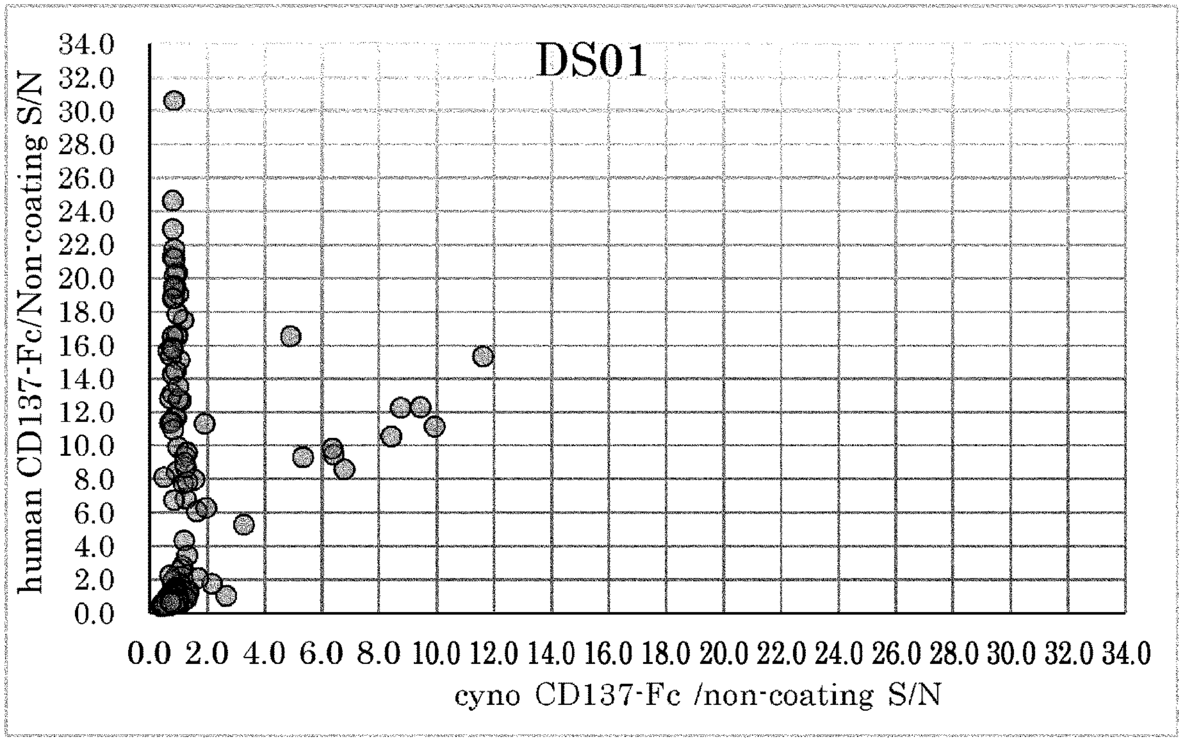

[Fig. 12.2]
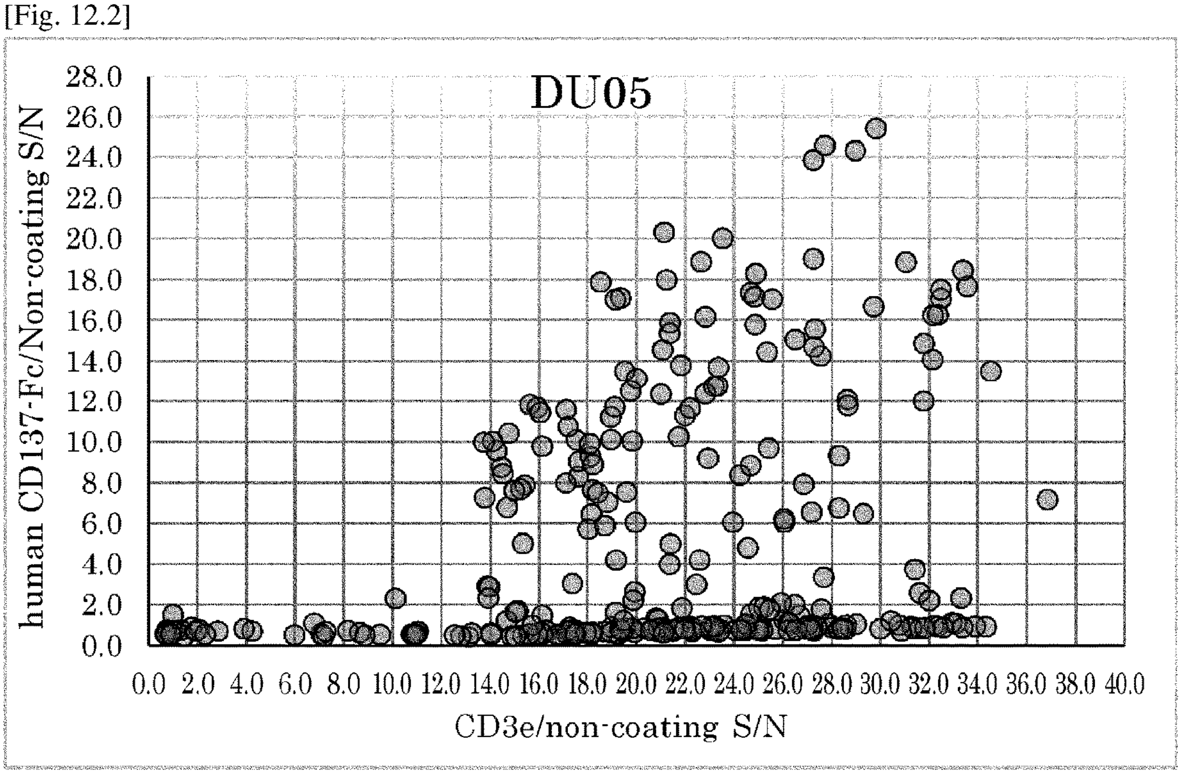
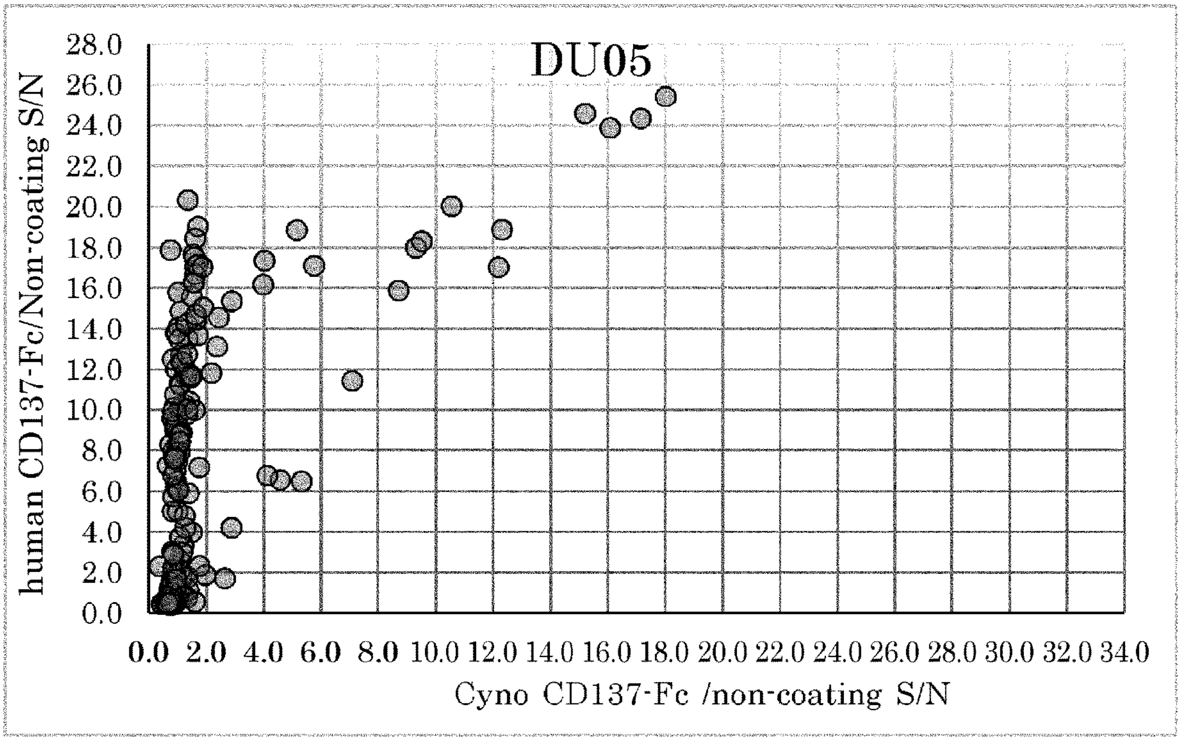

[Fig. 12.3]
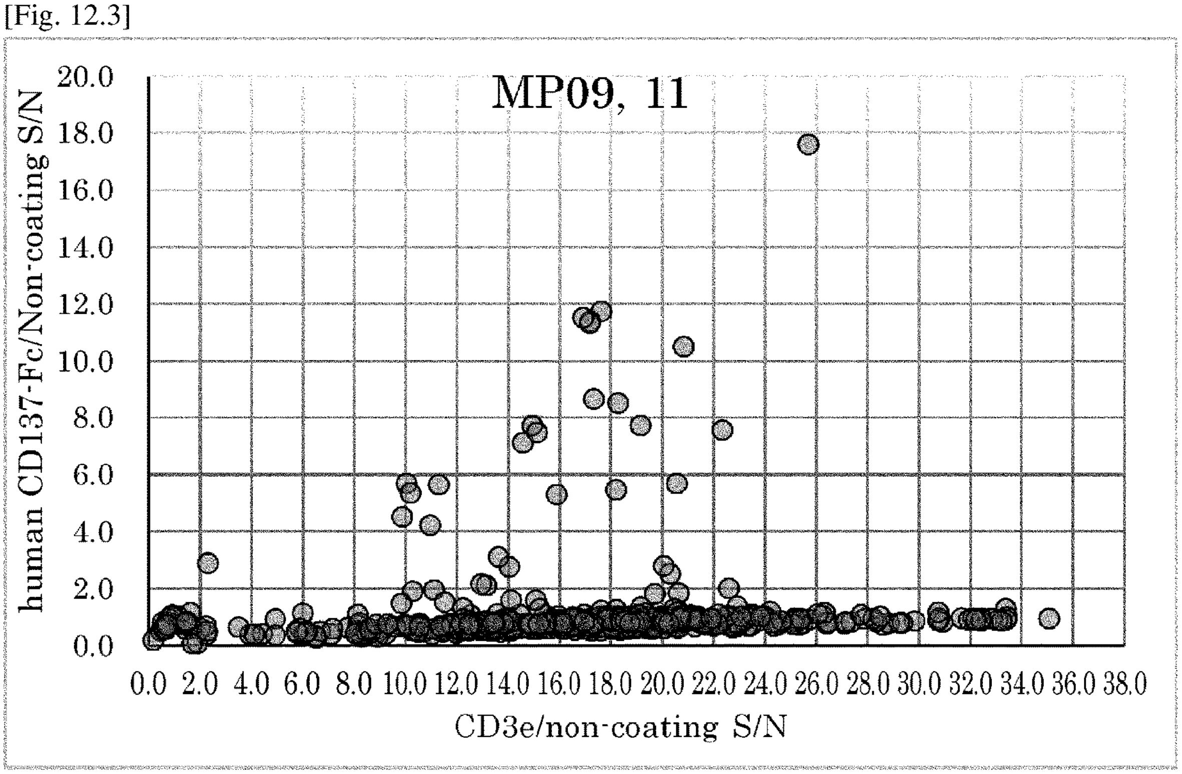
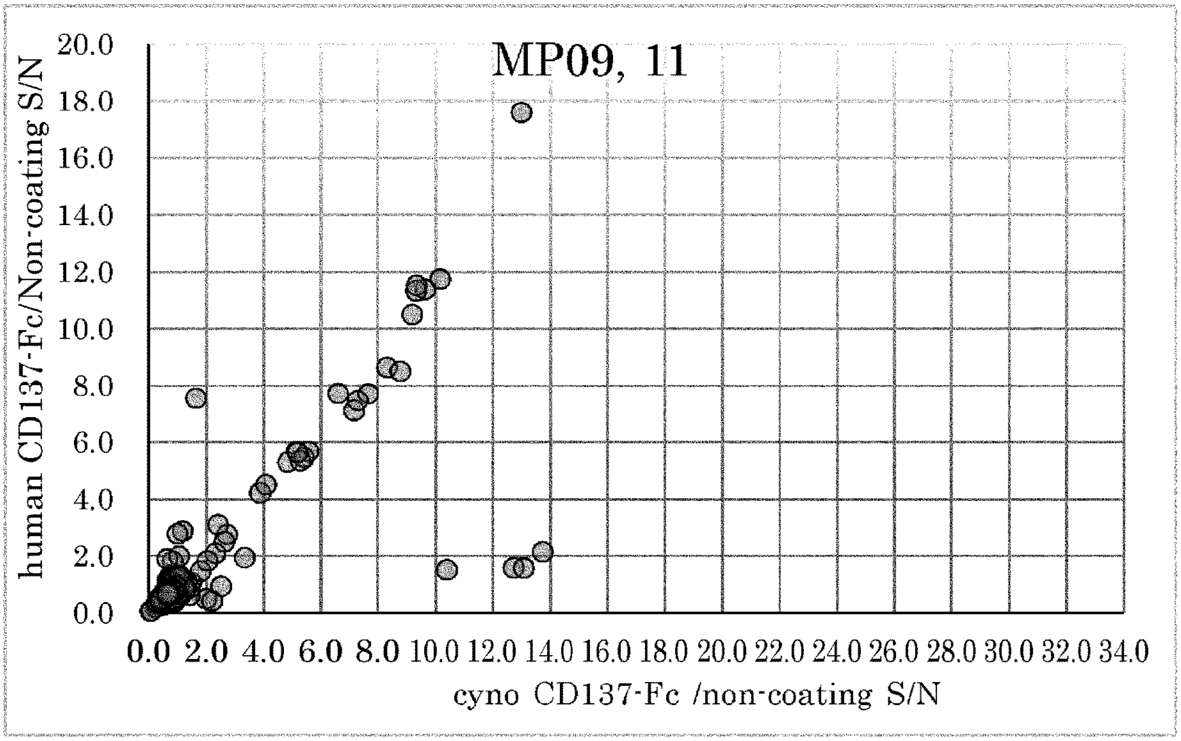

[Fig. 13]
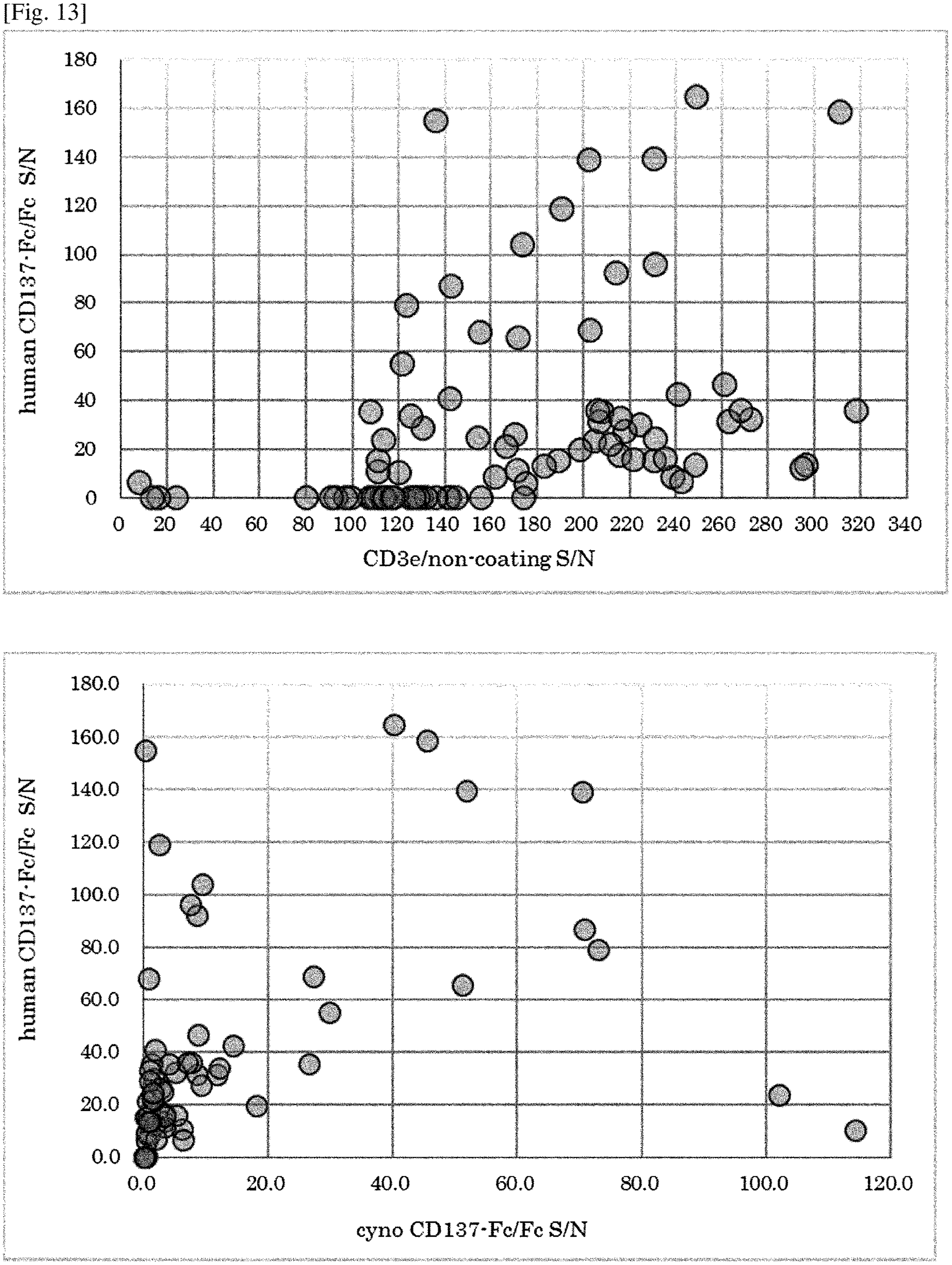

[Fig. 14]
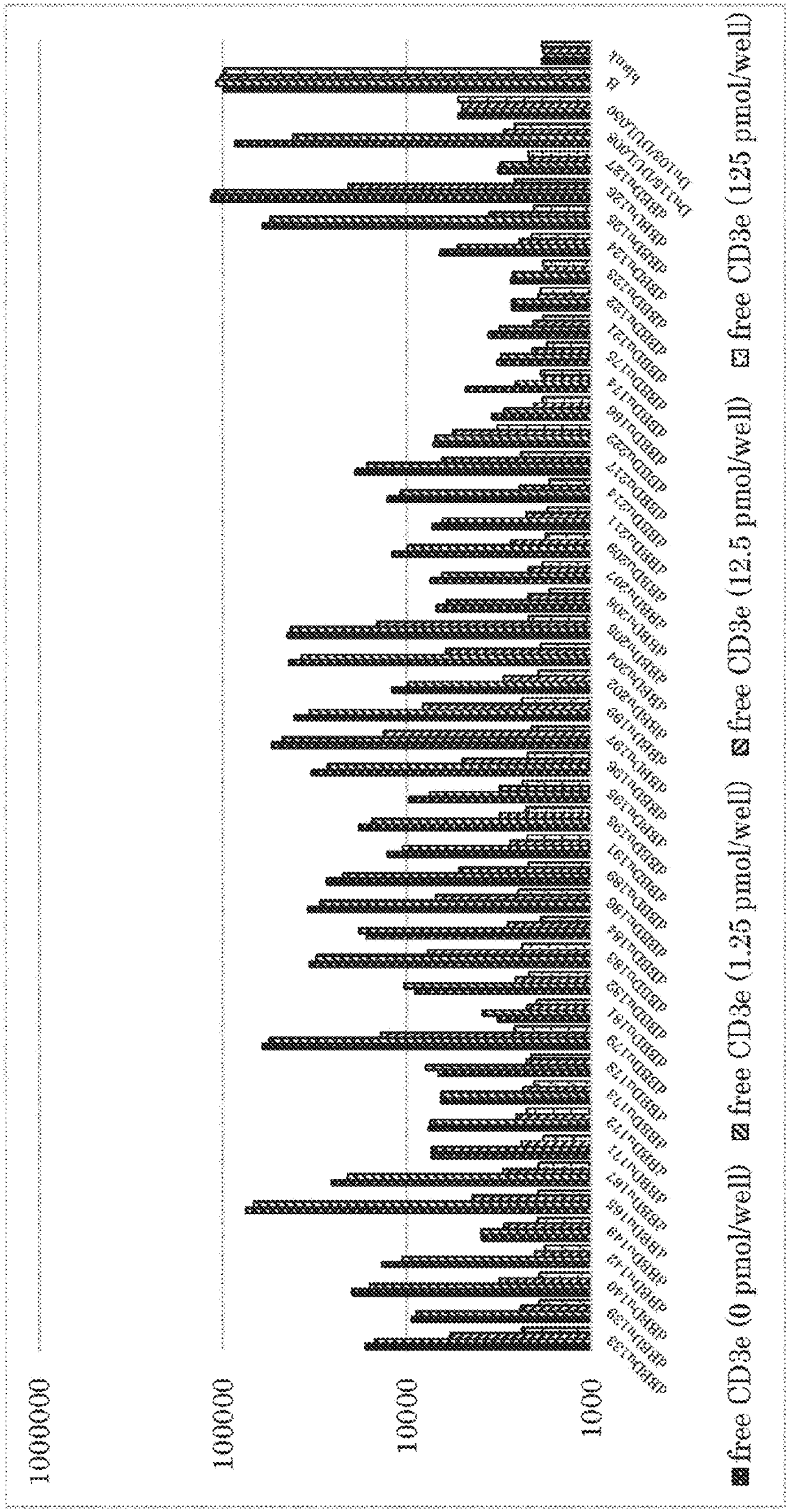

[Fig. 15]
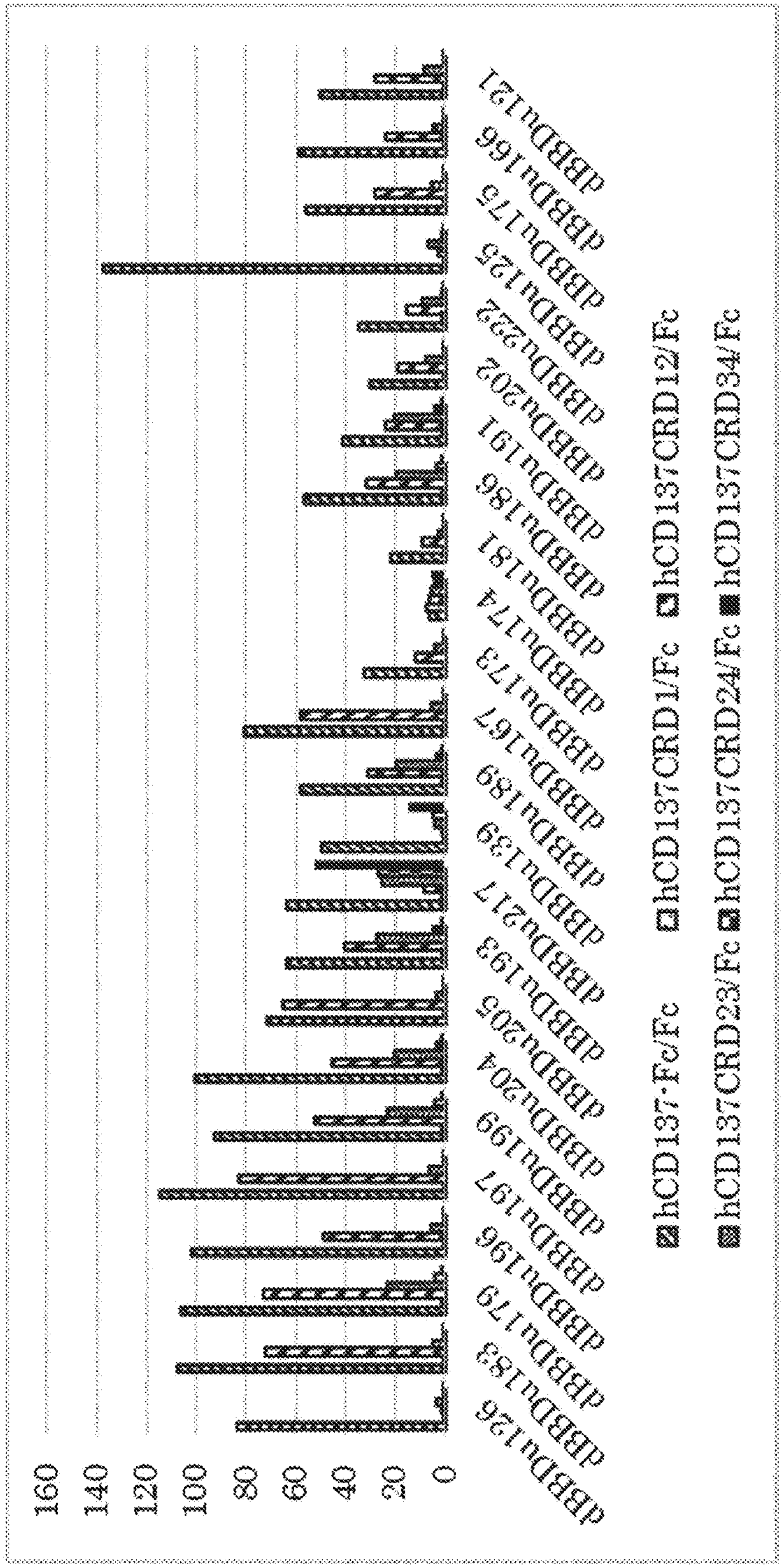

[Fig. 16]
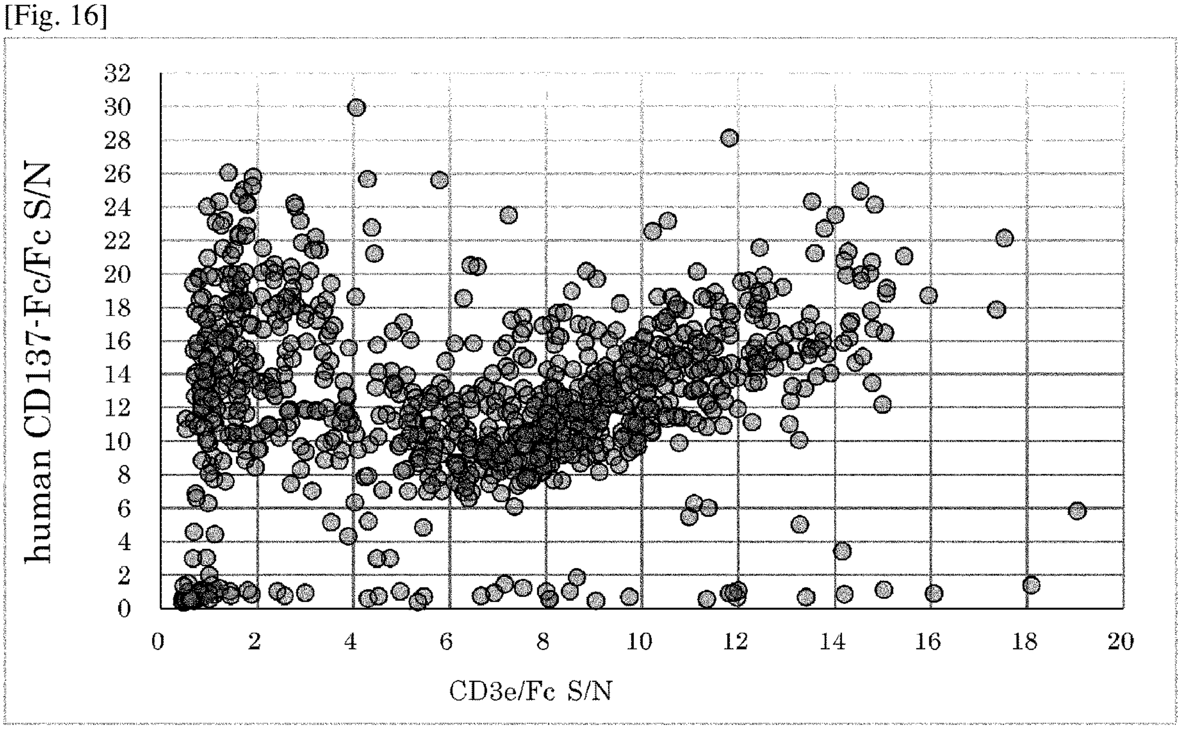
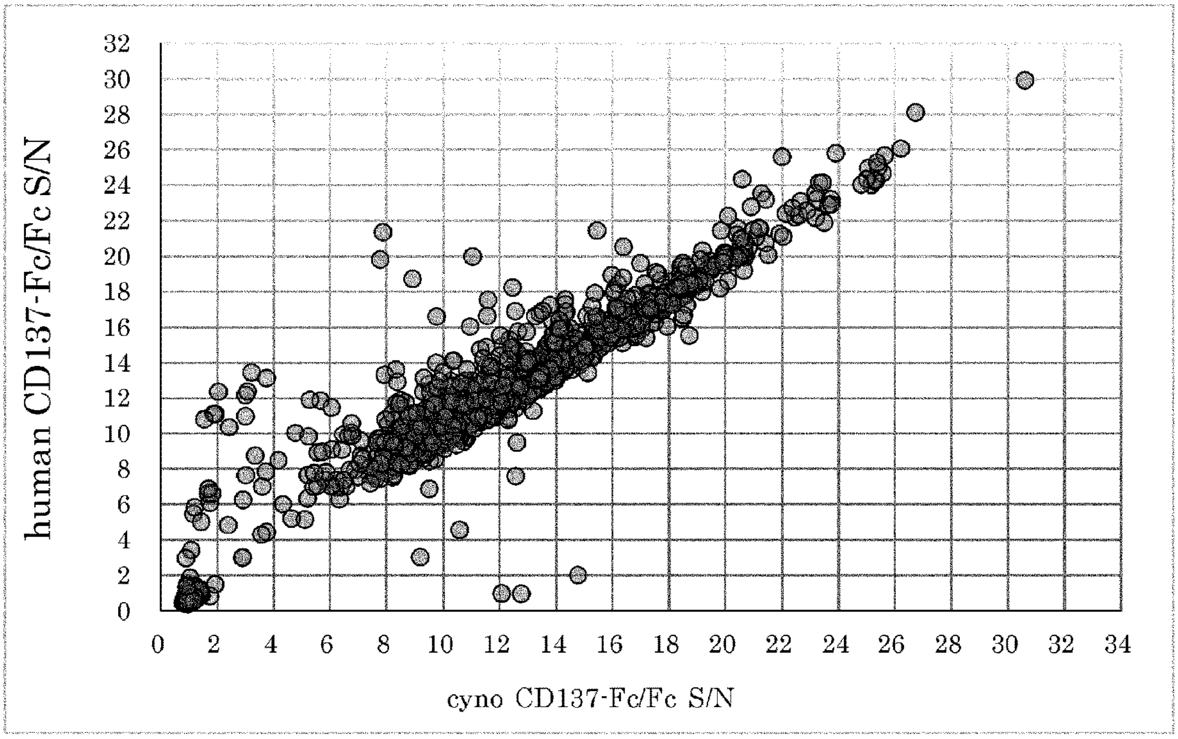

[Fig. 17.1]
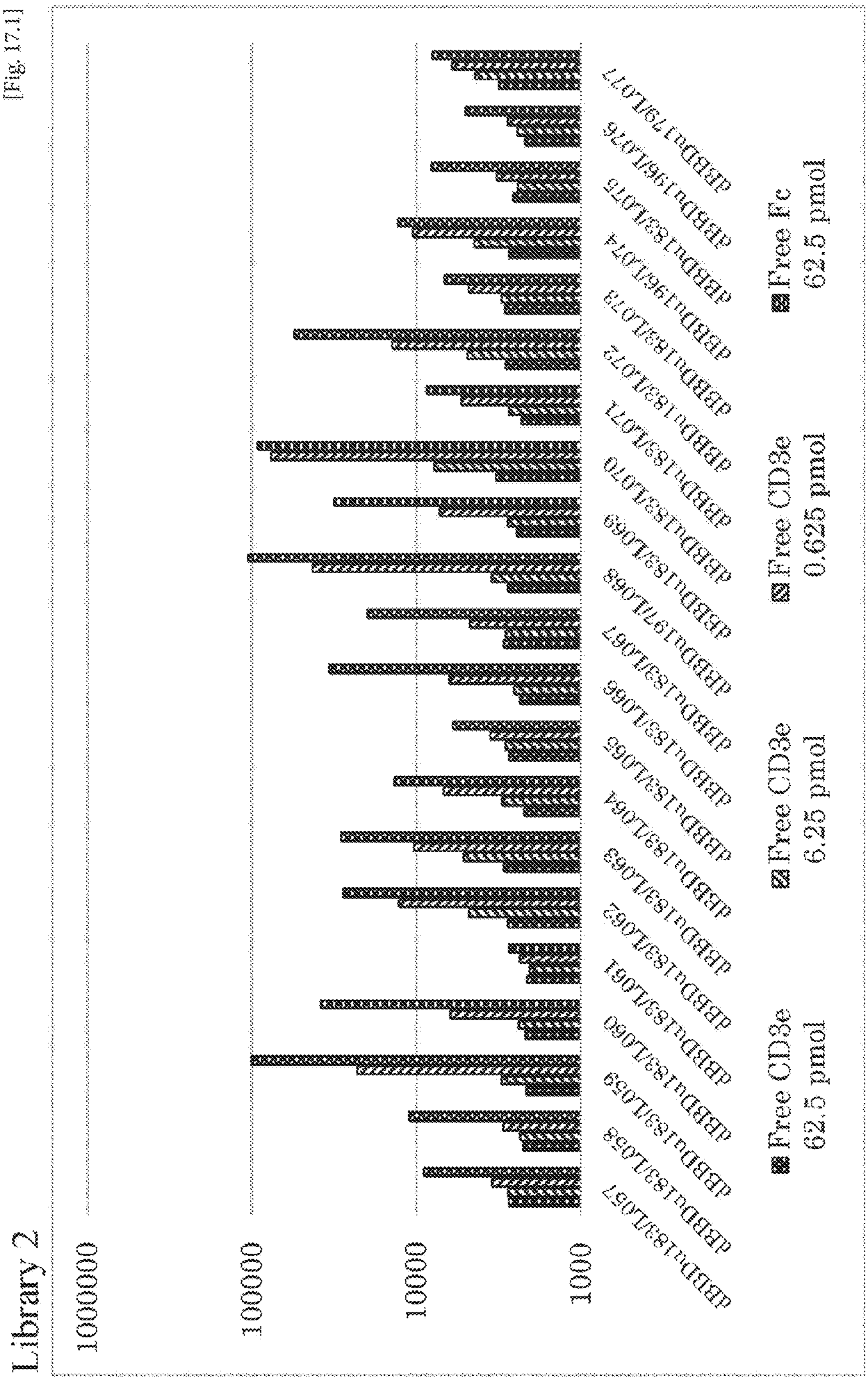

[Fig. 17.2]
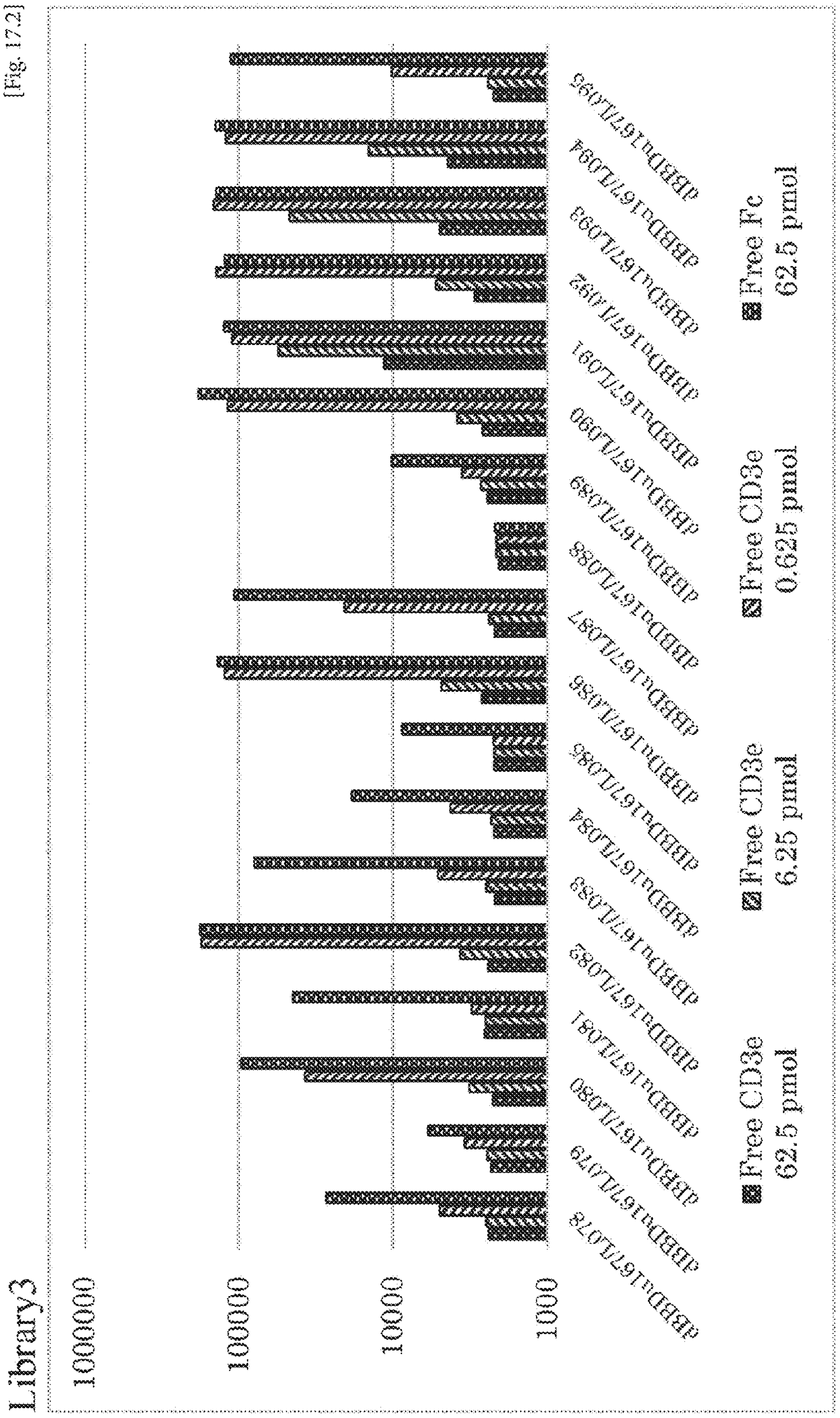

[Fig. 17.3]
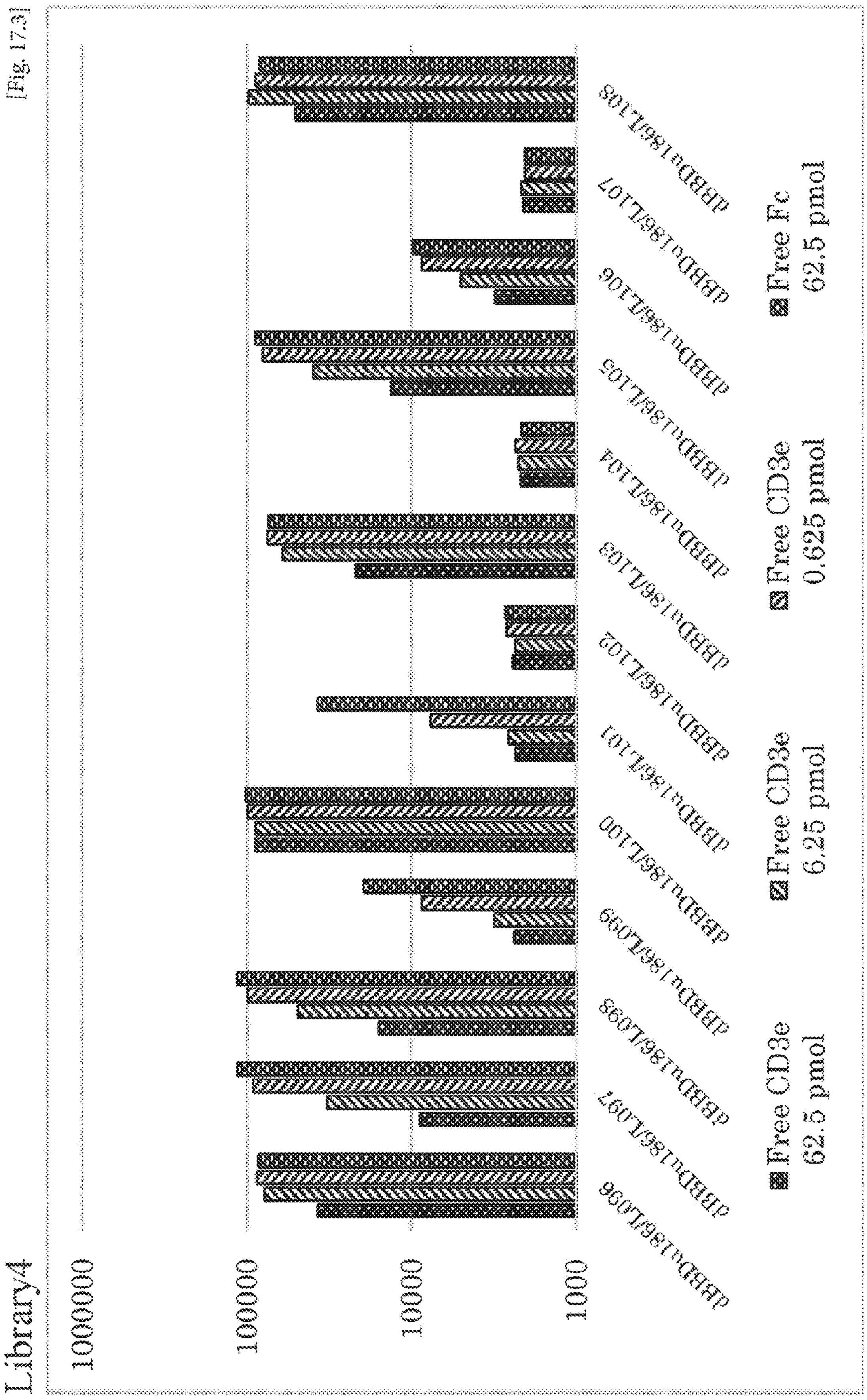

[Fig. 17.4]
Library5
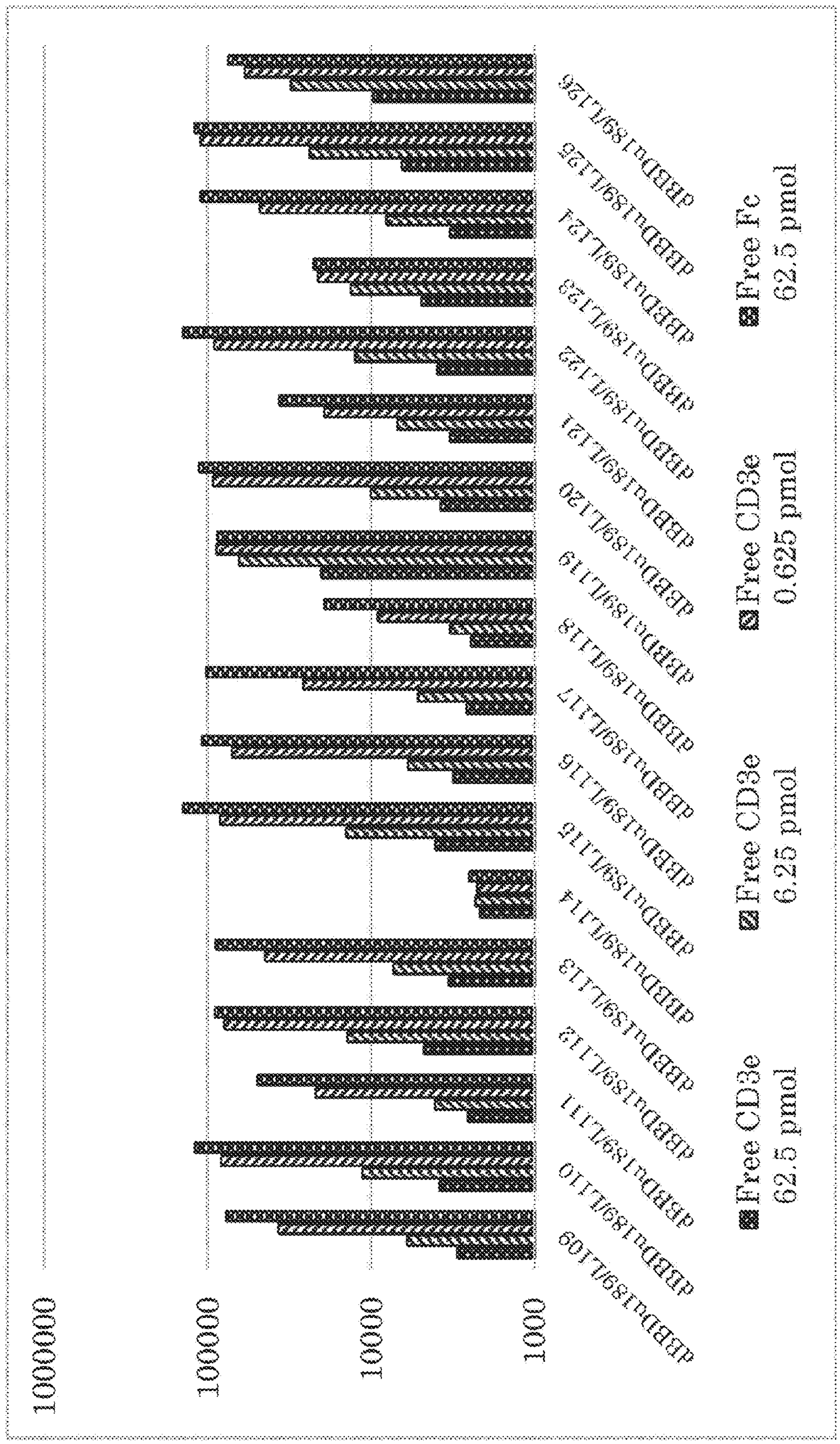

[Fig. 17.5]
Library6
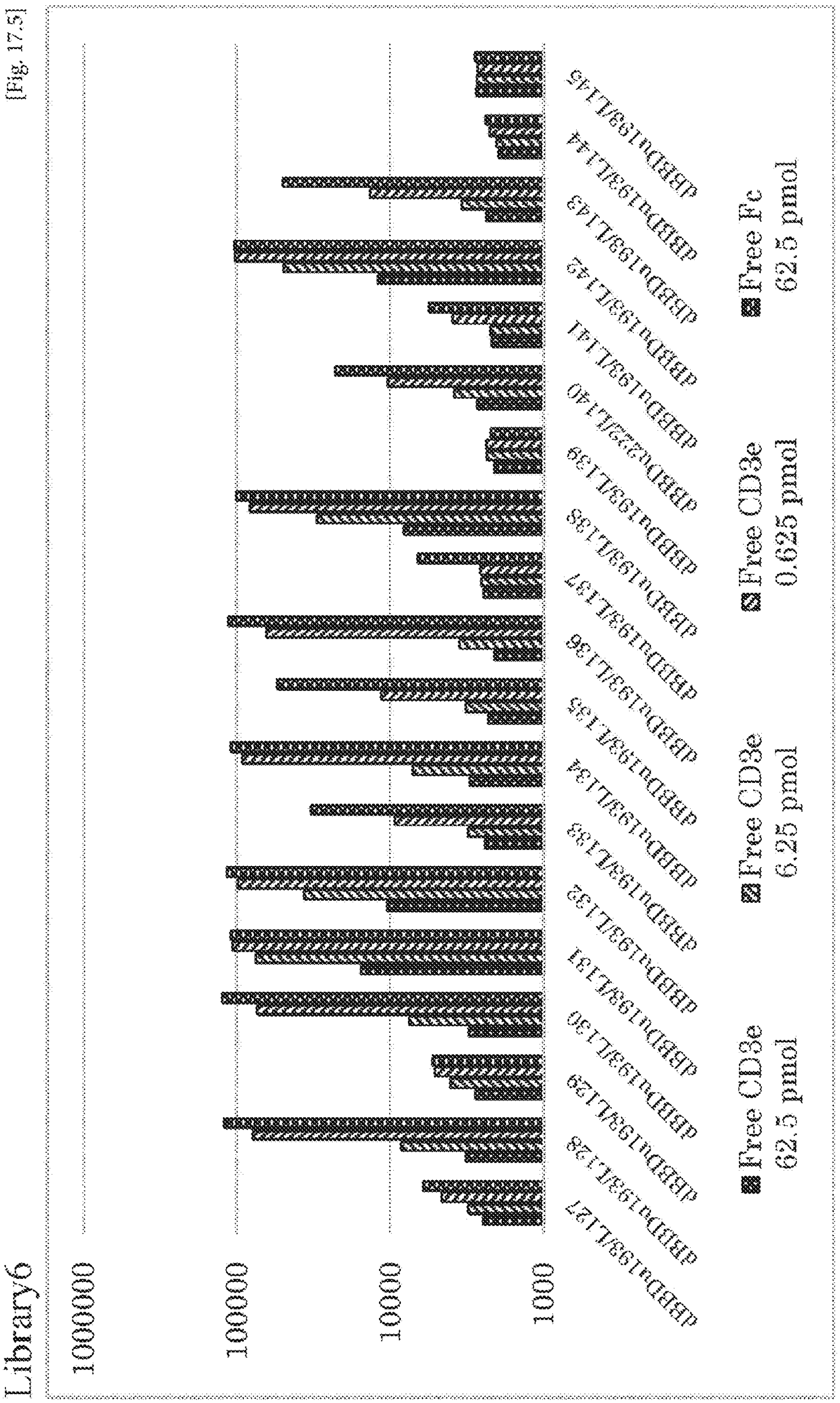

[Fig. 18A]
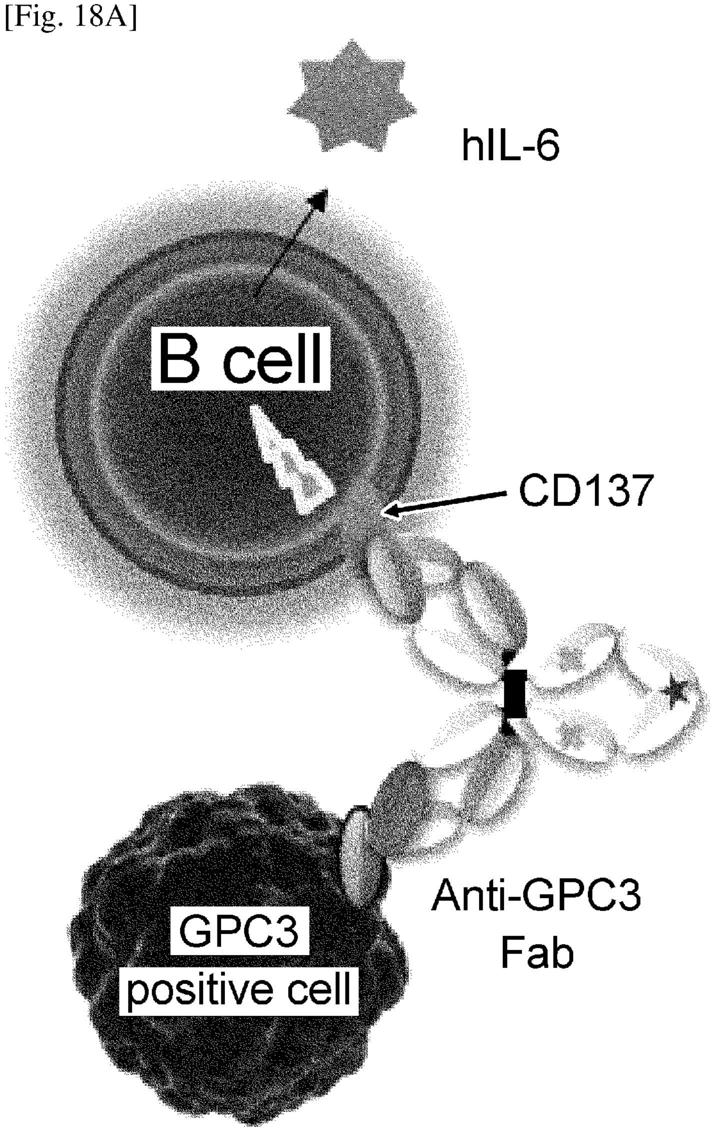

[Fig. 18B]
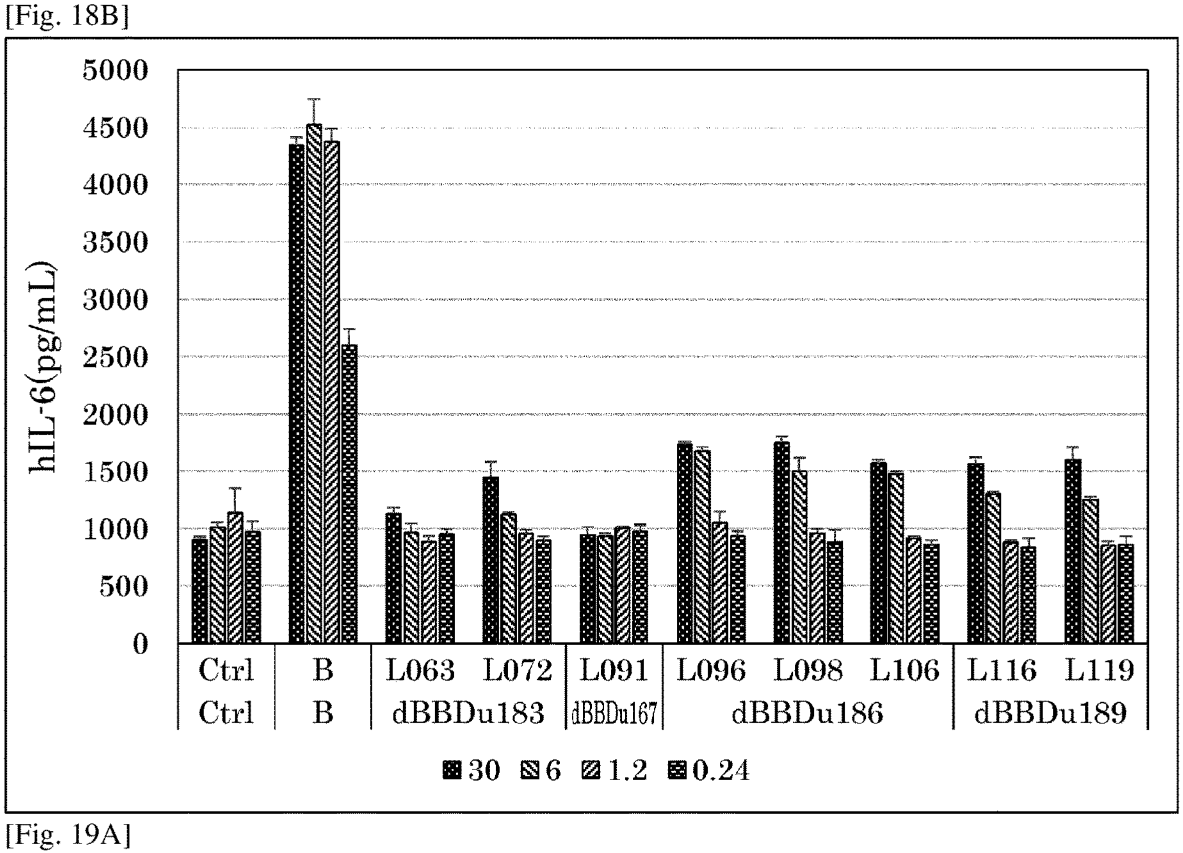
[Fig. 19A]
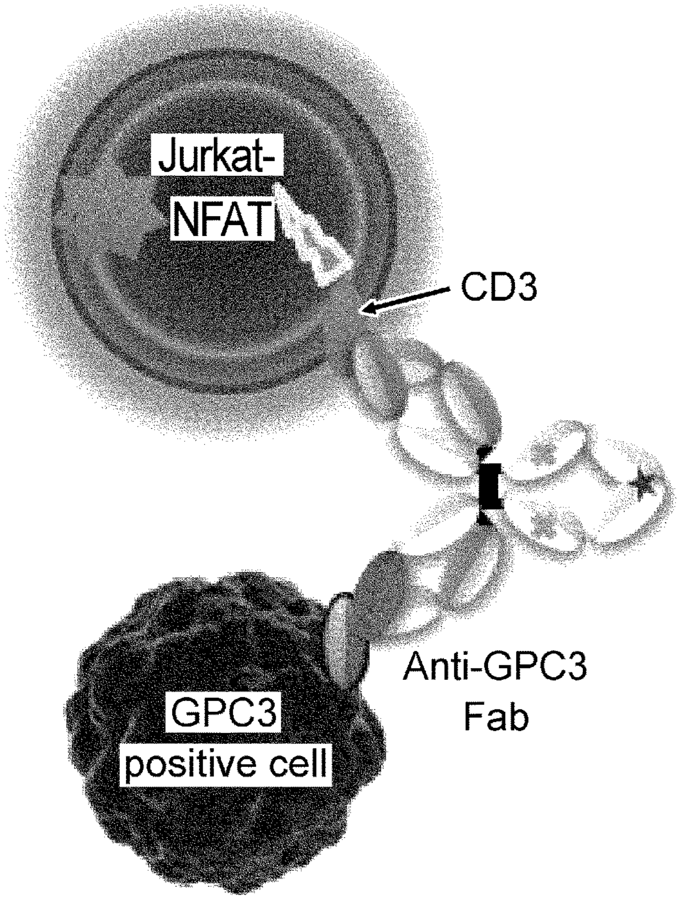

[Fig. 19B]
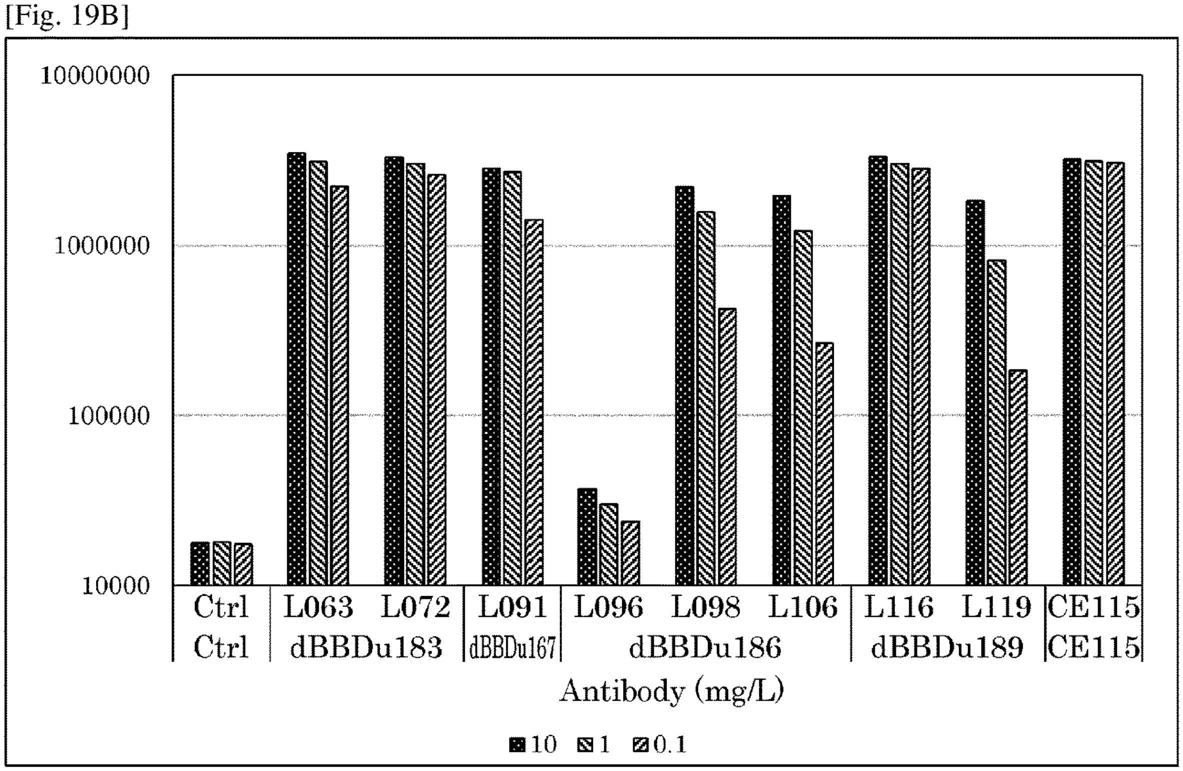
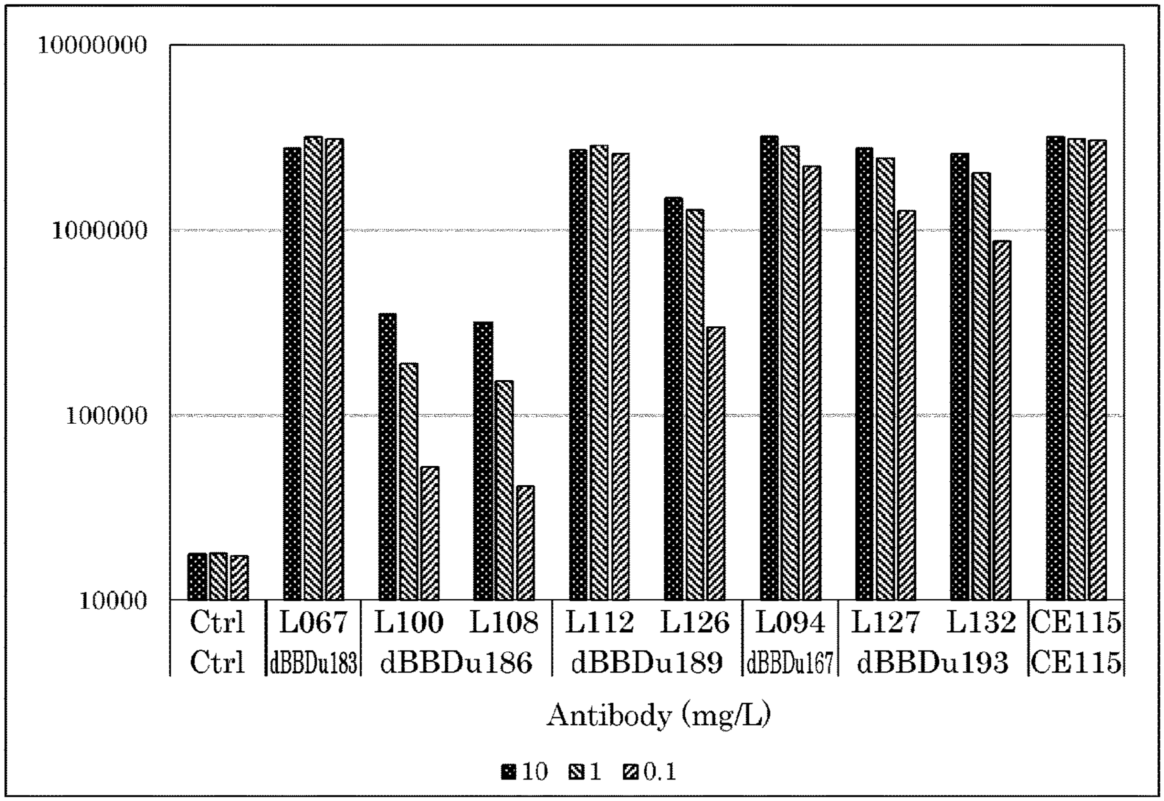

[Fig. 20]
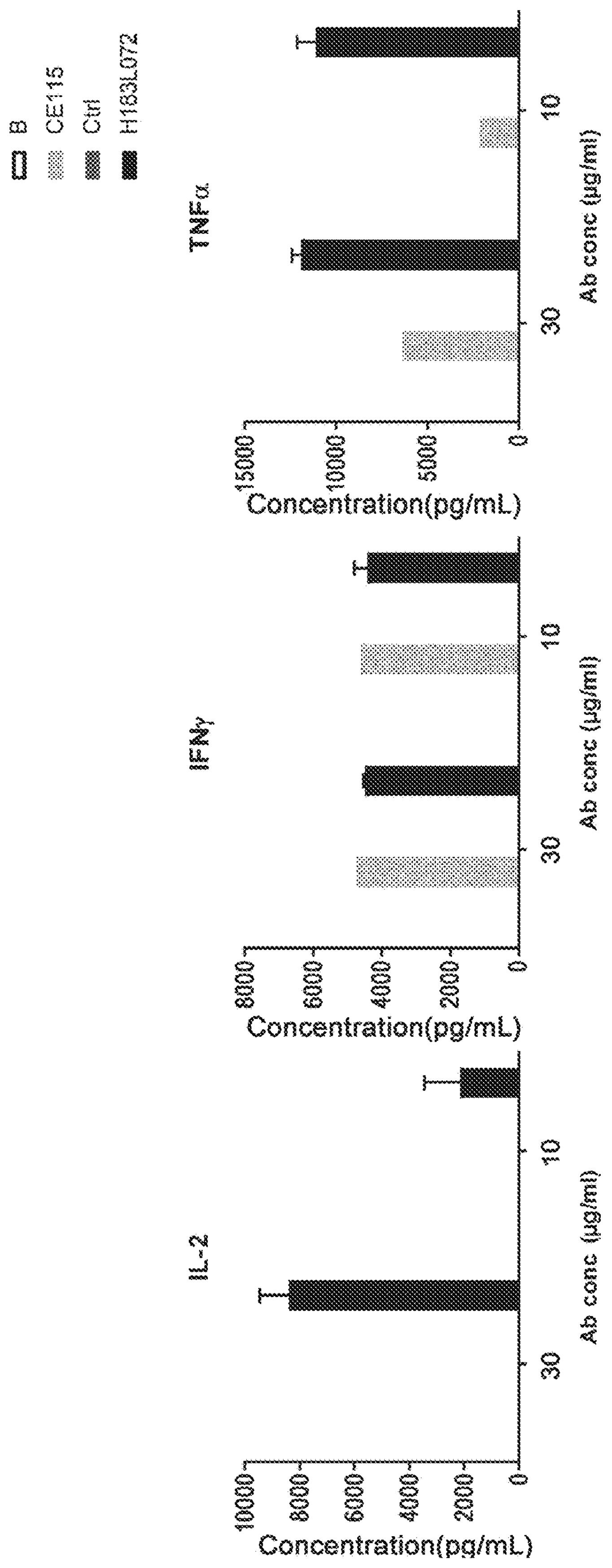

[Fig. 21]
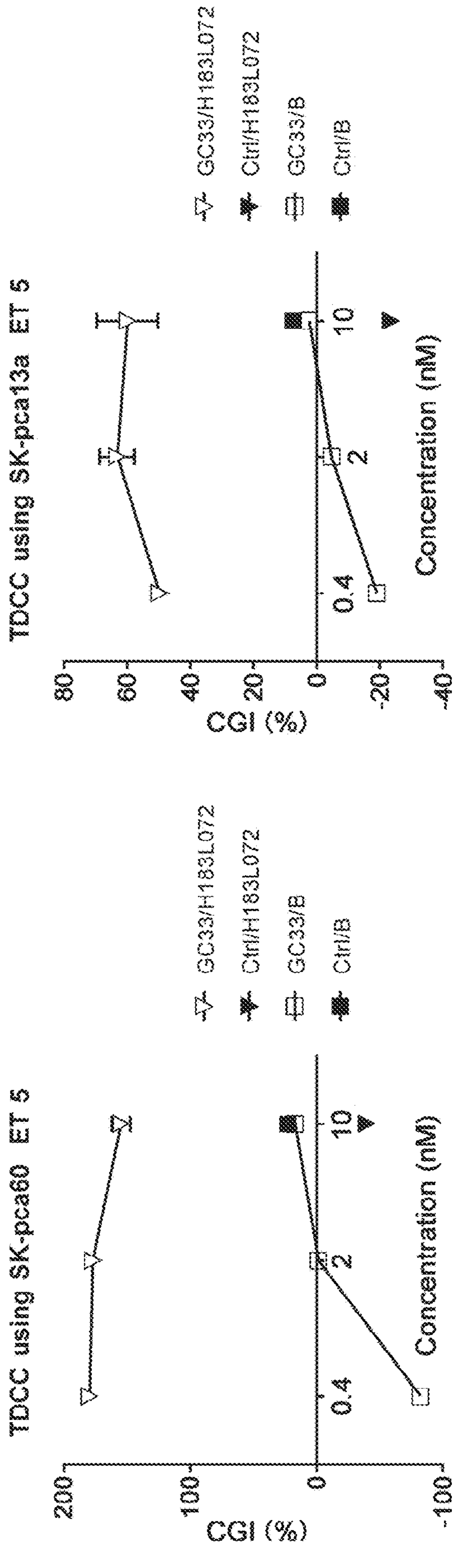

[Fig. 22]
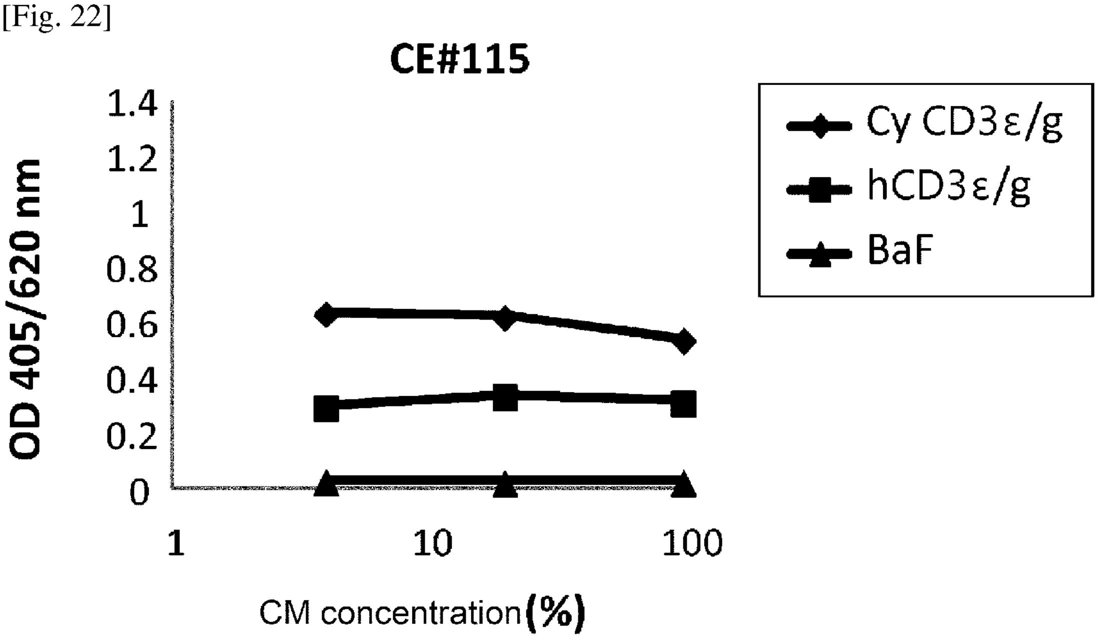
[Fig. 23]
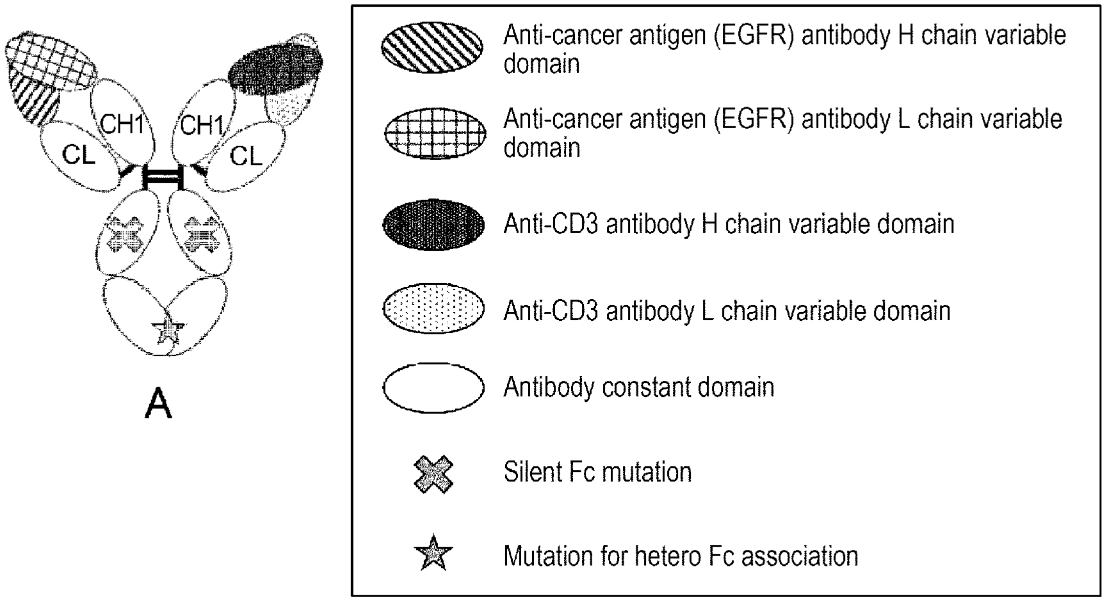

[Fig. 24]
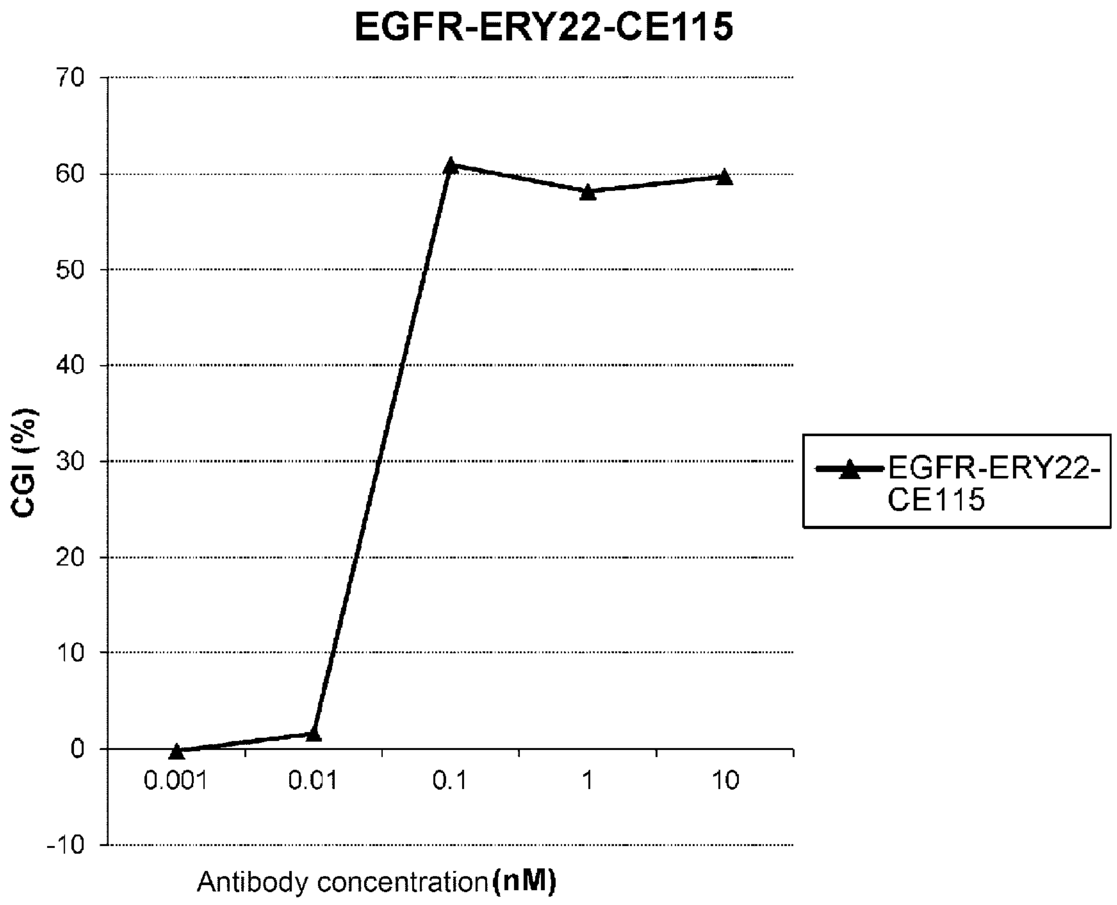

[Fig. 25]
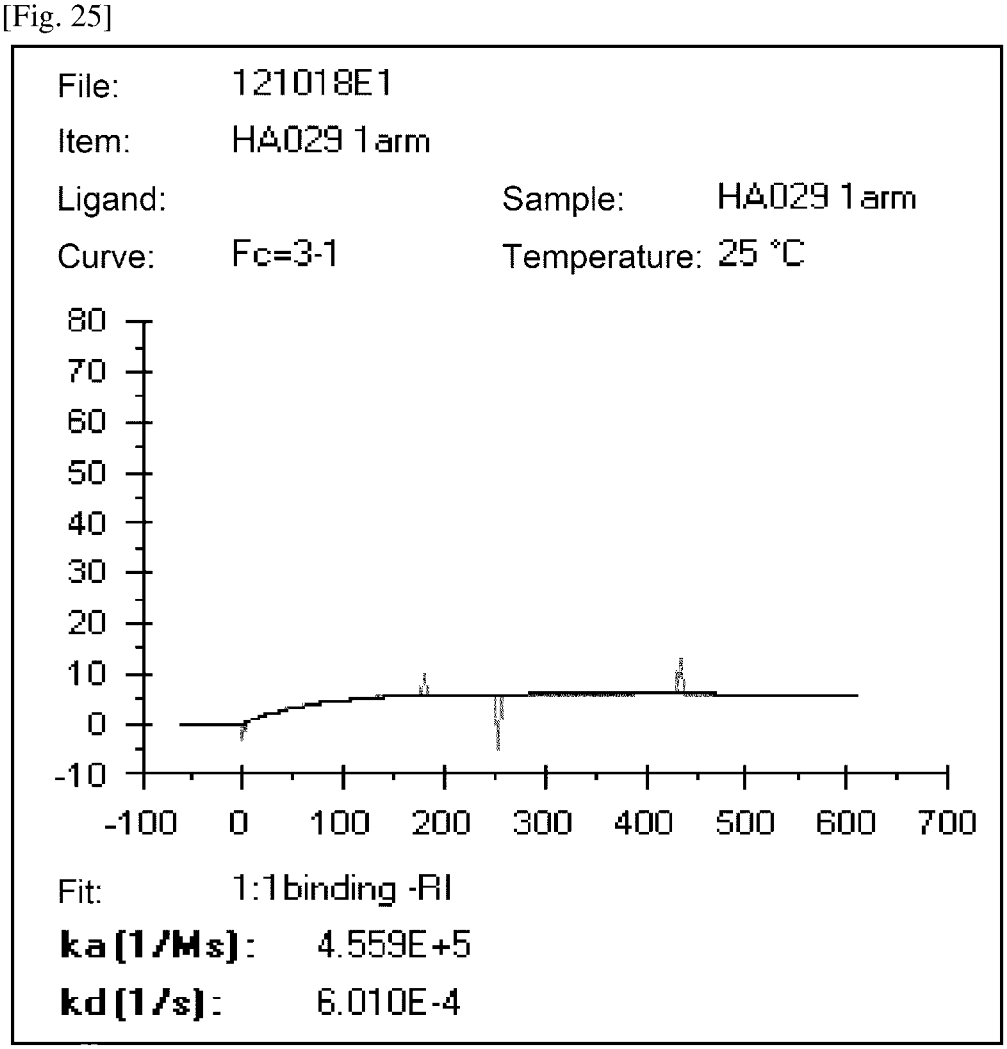
[Fig. 26]
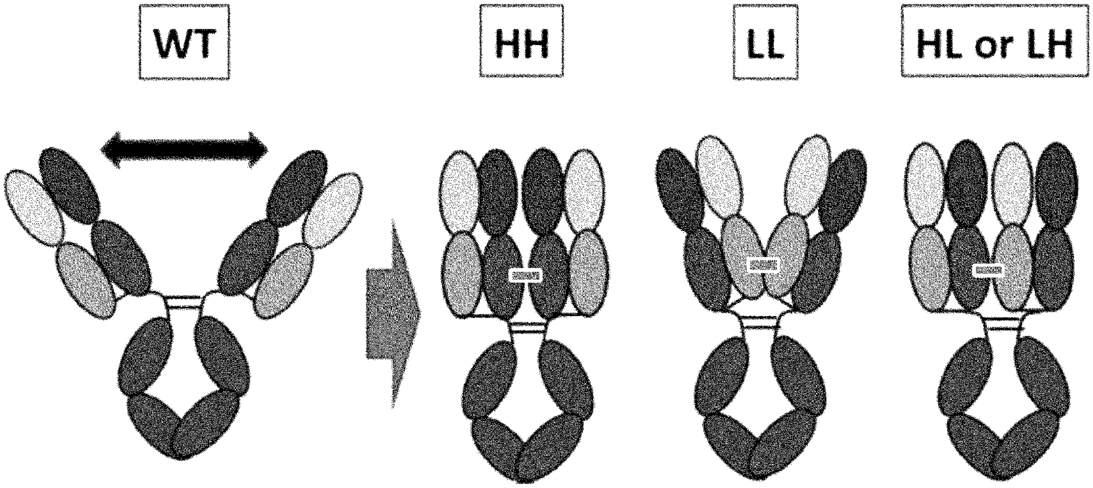

[Fig. 27]
| Antibody name | Antibody concentration (μg/mL) |
|---|---|
| MRAH.T68C-G1T4 | 100 |
| MRAH.V67C-G1T4 | 100 |
| MRAH.R66C-G1T4 | 100 |
| MRAH.T30C-G1T4 | 100 |
| MRAH.S28C-G1T4 | 100 |
| MRAH.G26C-G1T4 | 100 |
| MRAH.S25C-G1T4 | 100 |
| MRAH.T21C-G1T4 | 100 |
| MRAH.L20C-G1T4 | 100 |
| MRAH.S19C-G1T4 | 100 |
| MRAH.L18C-G1T4 | 100 |
| MRAH.T17C-G1T4 | 100 |
| MRAH.Q16C-G1T4 | 100 |
| MRAH.S15C-G1T4 | 100 |
| MRAH.P14C-G1T4 | 100 |
| MRAH.R13C-G1T4 | 100 |
| MRAH.V12C-G1T4 | 100 |
| MRAH.L11C-G1T4 | 100 |
| MRAH.G10C-G1T4 | 100 |
| MRAH.P9C-G1T4 | 100 |
| MRAH.G8C-G1T4 | 100 |
| MRAH.S7C-G1T4 | 100 |
| MRAH.Q5C-G1T4 | 100 |
| MRA | 100 |
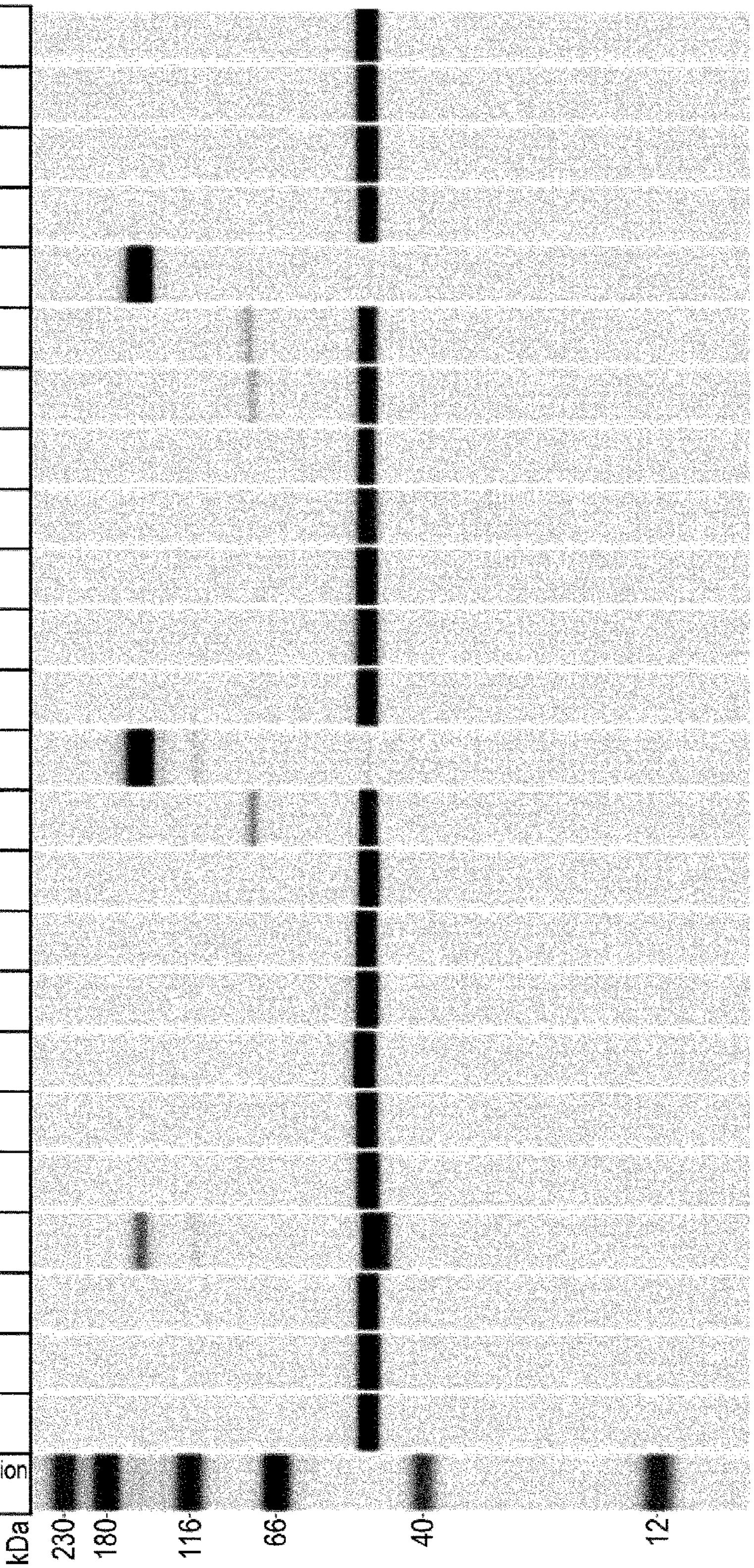

[Fig. 28]
| | |
|---|---|
| MRAH.S113C-G1T4 | 100 |
| MRAH.S112C-G1T4 | 100 |
| MRAH.V82cC-G1T4 | 100 |
| MRAH.S82bC-G1T4 | 100 |
| MRAH.S82aC-G1T4 | 100 |
| MRAH.L82C-G1T4 | 100 |
| MRAH.R81C-G1T4 | 100 |
| MRAH.L80C-G1T4 | 100 |
| MRAH.S79C-G1T4 | 100 |
| MRAH.Q77C-G1T4 | 100 |
| MRAH.K75C-G1T4 | 100 |
| MRAH.S74C-G1T4 | 100 |
| MRAH.T73C-G1T4 | 100 |
| MRAH.D72C-G1T4 | 100 |
| MRAH.L70C-G1T4 | 100 |
| Antibody name | Antibody concentration (μg/mL) |
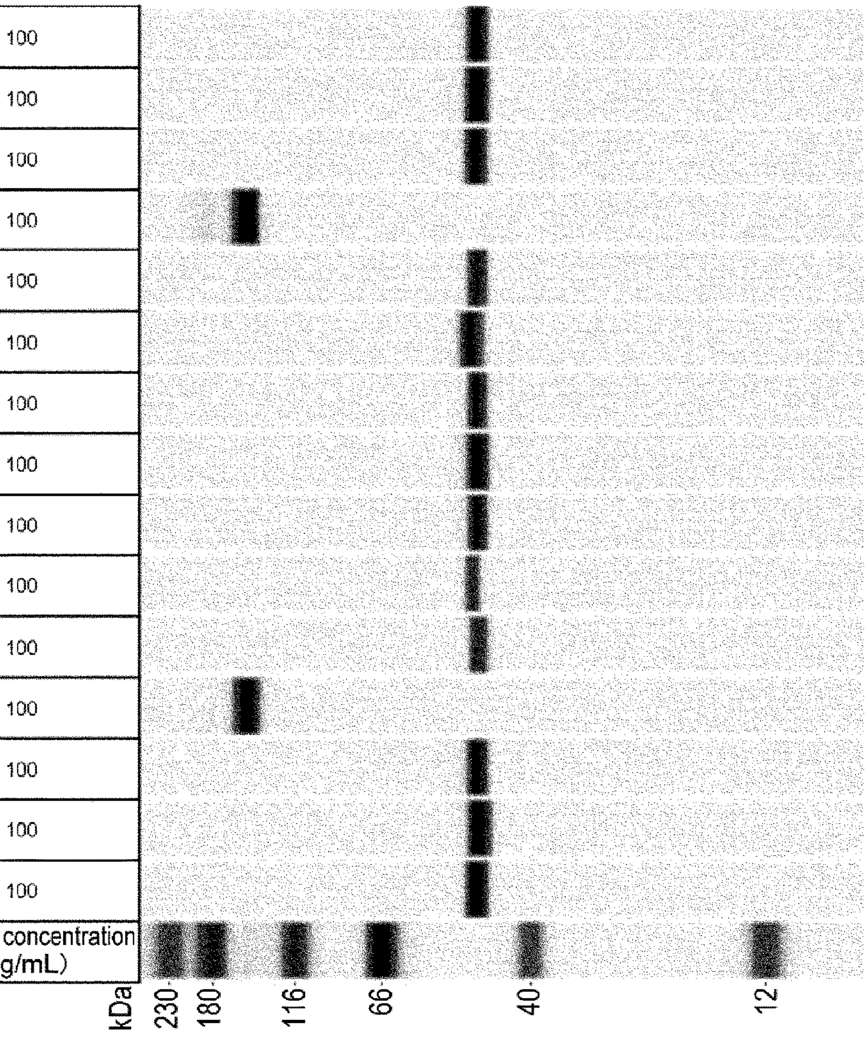

[Fig. 29]
| | |
|---|---|
| MRAH-G1T4.F150C | 20 |
| MRAH-G1T4.Y149C | 20 |
| MRAH-G1T4.D148C | 20 |
| MRAH-G1T4.A141C | 20 |
| MRAH-G1T4.A140C | 20 |
| MRAH-G1T4.T139C | 20 |
| MRAH-G1T4.G137C | 20 |
| MRAH-G1T4.S136C | 20 |
| MRAH-G1T4.T135C | 20 |
| MRAH-G1T4.S134C | 20 |
| MRAH-G1T4.K133C | 20 |
| MRAH-G1T4.S132C | 20 |
| MRAH-G1T4.S131C | 20 |
| MRAH-G1T4.P127C | 20 |
| MRAH-G1T4.F126C | 20 |
| MRAH-G1T4.V125C | 20 |
| MRAH-G1T4.P123C | 20 |
| MRAH-G1T4.G122C | 20 |
| MRAH-G1T4.K121C | 20 |
| MRAH-G1T4.T120C | 20 |
| MRAH-G1T4.S119C | 20 |
| MRAH-G1T4.A118C | 20 |
| MRA | 20 |
| Antibody name | Antibody concentration (μg/mL) |
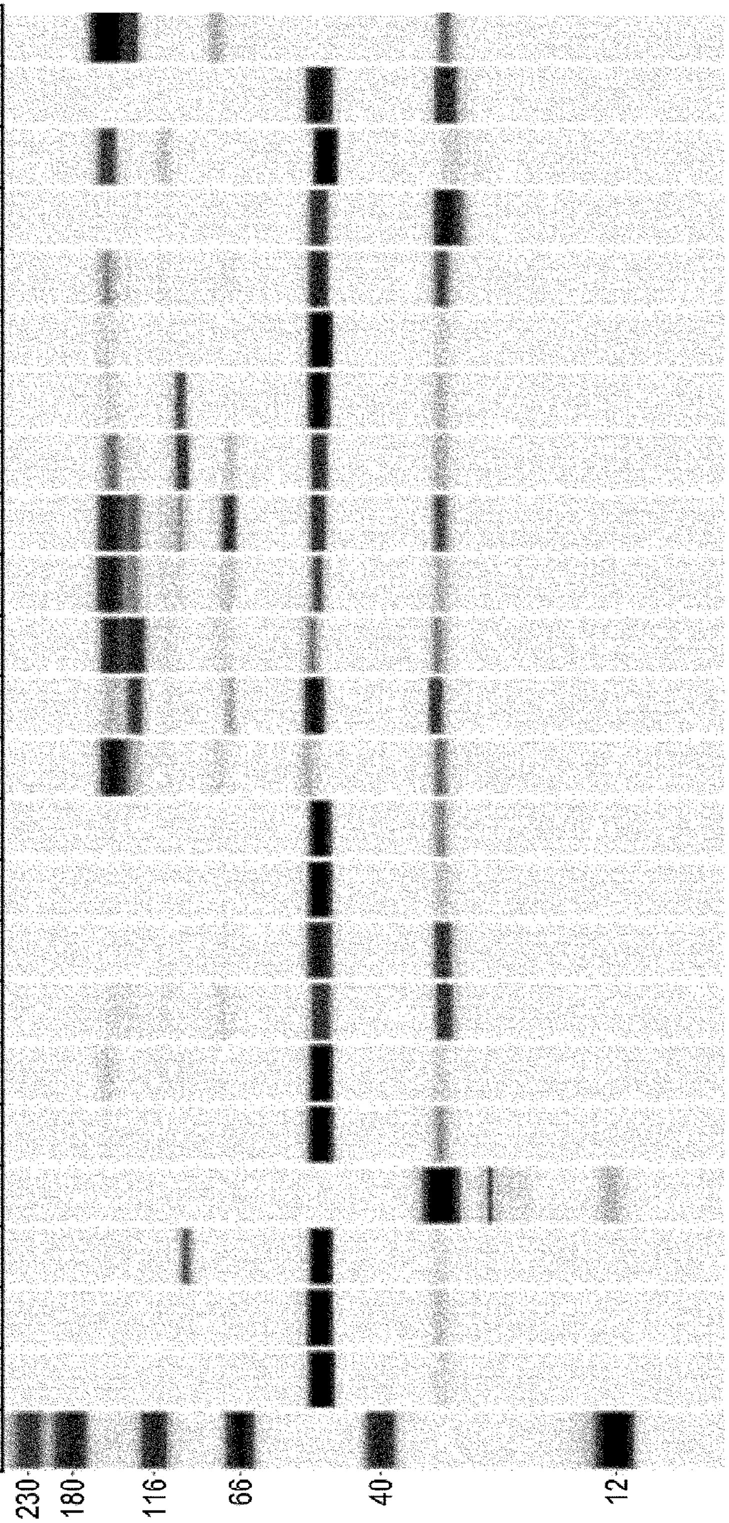

[Fig. 30]
| | |
|---|---|
| MRAH-G1T4.L179C | 20 |
| MRAH-G1T4.G178C | 20 |
| MRAH-G1T4.S177C | 20 |
| MRAH-G1T4.S176C | 20 |
| MRAH-G1T4.Q175C | 20 |
| MRAH-G1T4.L174C | 20 |
| MRAH-G1T4.V173C | 20 |
| MRAH-G1T4.V167C | 20 |
| MRAH-G1T4.G166C | 20 |
| MRAH-G1T4.S165C | 20 |
| MRAH-G1T4.T164C | 20 |
| MRAH-G1T4.L163C | 20 |
| MRAH-G1T4.A162C | 20 |
| MRAH-G1T4.G161C | 20 |
| MRAH-G1T4.S160C | 20 |
| MRAH-G1T4.N159C | 20 |
| MRAH-G1T4.W158C | 20 |
| MRAH-G1T4.S157C | 20 |
| MRAH-G1T4.V156C | 20 |
| MRAH-G1T4.T155C | 20 |
| MRAH-G1T4.V154C | 20 |
| MRAH-G1T4.P153C | 20 |
| MRAH-G1T4.E152C | 20 |
| MRAH-G1T4.P151C | 20 |
| Antibody name | Antibody concentration (μg/mL) |
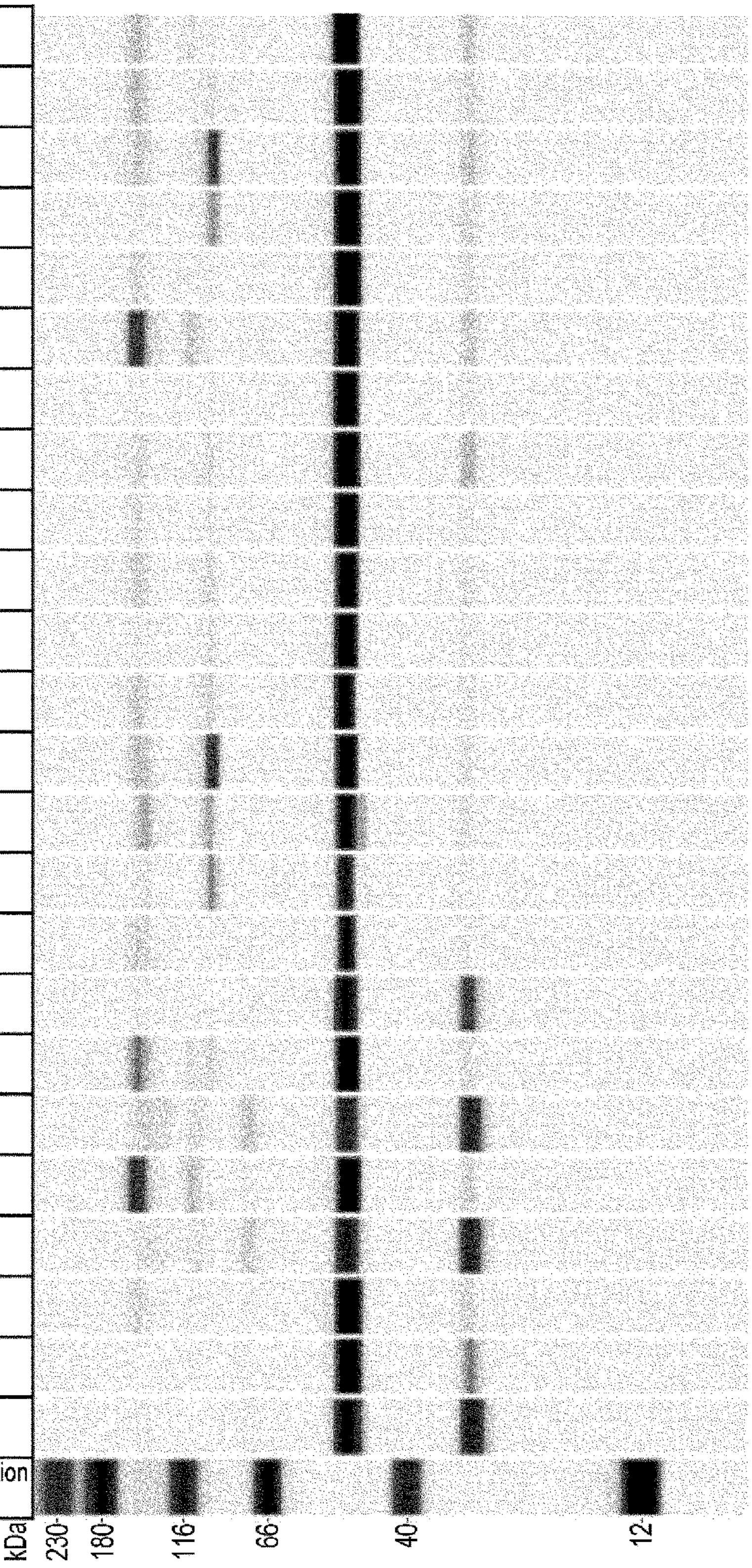

[Fig. 31]
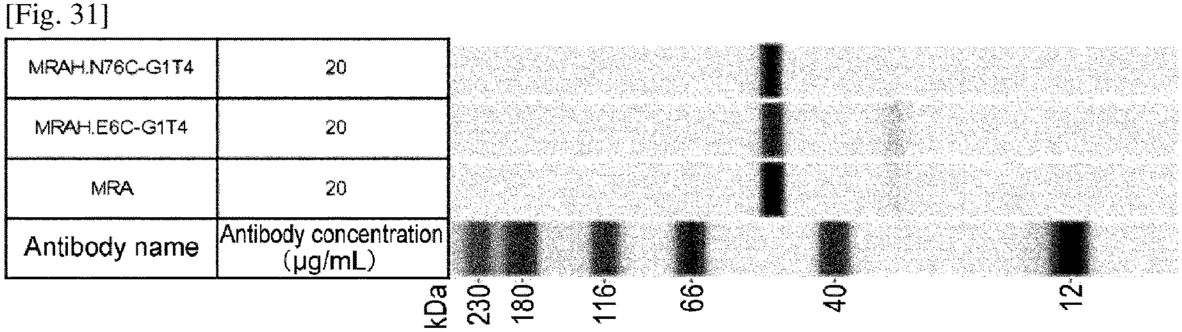

[Fig. 32]
| Antibody name | Antibody concentration (μg/mL) |
|---|---|
| MRAH-G1T4.K210C | 20 |
| MRAH-G1T4.T209C | 20 |
| MRAH-G1T4.N208C | 20 |
| MRAH-G1T4.P206C | 20 |
| MRAH-G1T4.K205C | 20 |
| MRAH-G1T4.H204C | 20 |
| MRAH-G1T4.N203C | 20 |
| MRAH-G1T4.V202C | 20 |
| MRAH-G1T4.N201C | 20 |
| MRAH-G1T4.I199C | 20 |
| MRAH-G1T4.Y198C | 20 |
| MRAH-G1T4.T197C | 20 |
| MRAH-G1T4.Q196C | 20 |
| MRAH-G1T4.T195C | 20 |
| MRAH-G1T4.G194C | 20 |
| MRAH-G1T4.L193C | 20 |
| MRAH-G1T4.S192C | 20 |
| MRAH-G1T4.S191C | 20 |
| MRAH-G1T4.S190C | 20 |
| MRAH-G1T4.P189C | 20 |
| MRAH-G1T4.V188C | 20 |
| MRAH-G1T4.T187C | 20 |
| MRAH-G1T4.V186C | 20 |
| MRAH-G1T4.Y180C | 20 |
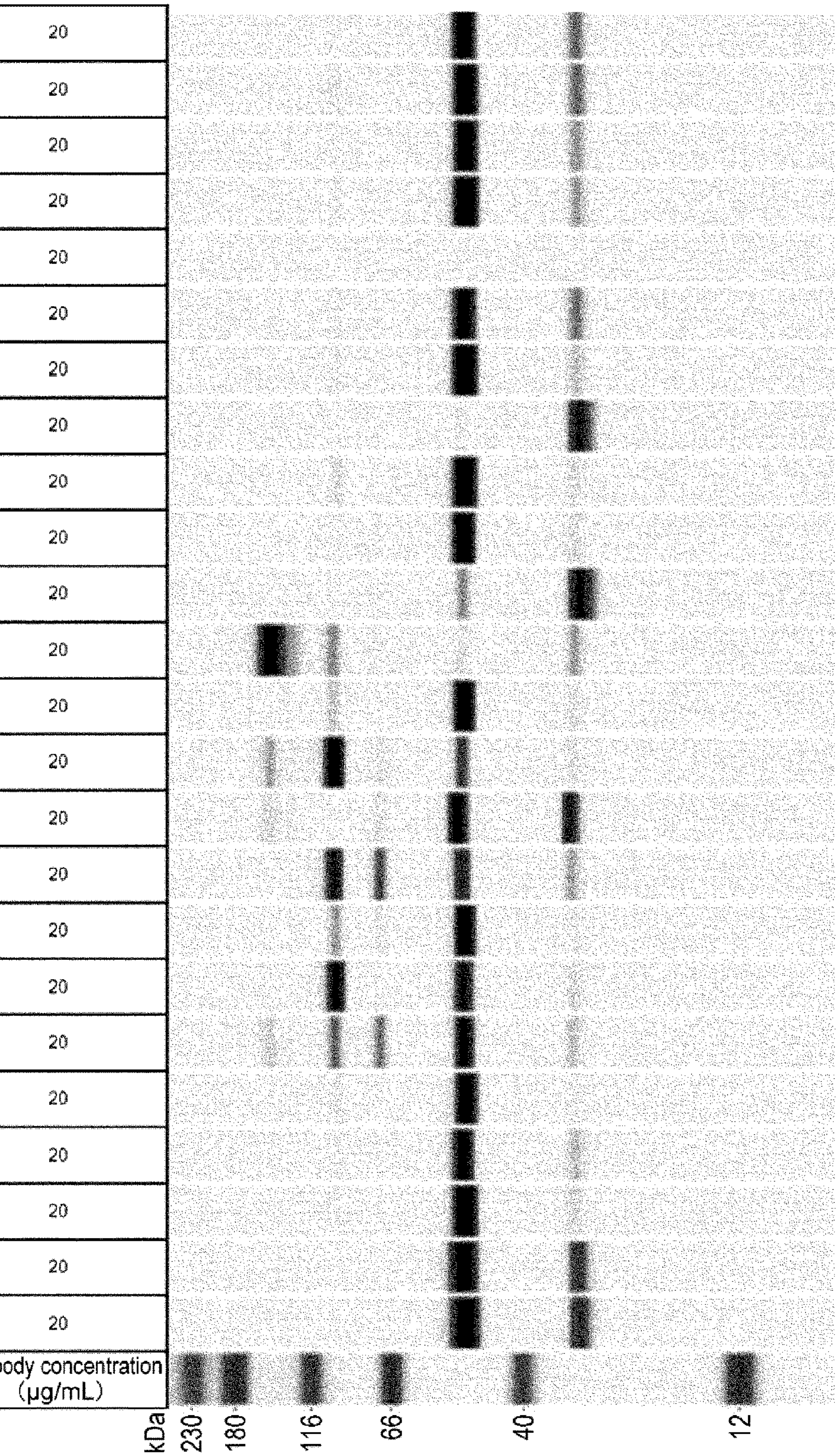

[Fig. 33]
| Antibody name | Antibody concentration (μg/mL) |
|---|---|
| MRAH-G1T4.S219C | 20 |
| MRAH-G1T4.K218C | 20 |
| MRAH-G1T4.P217C | 20 |
| MRAH-G1T4.E216C | 20 |
| MRAH-G1T4.V215C | 20 |
| MRAH-G1T4.R214C | 20 |
| MRAH-G1T4.K213C | 20 |
| MRAH-G1T4.D212C | 20 |
| MRAH-G1T4.V211C | 20 |
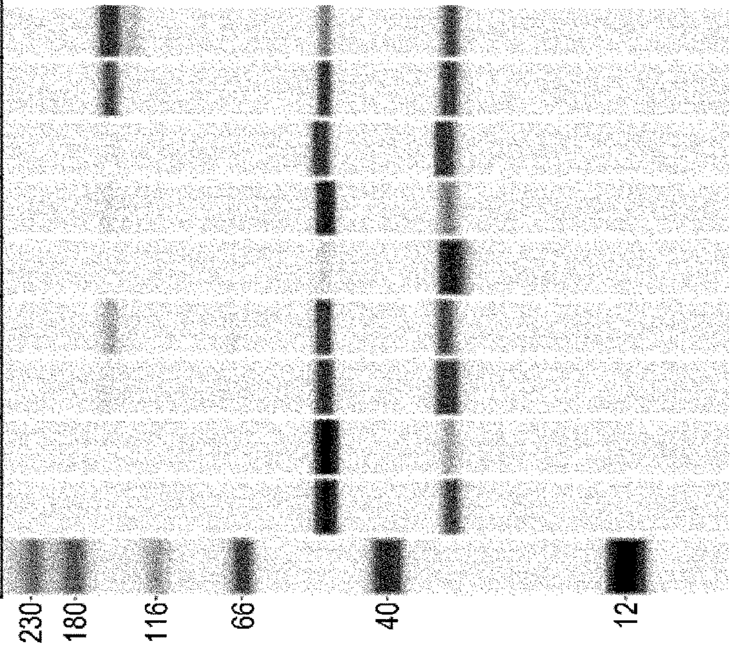
[Fig. 34]
| Antibody name | Antibody concentration (μg/mL) |
|---|---|
| MRAH.Y102C-G1T4 | 20 |
| MRAH.D101C-G1T4 | 20 |
| MRAH.S65C-G1T4 | 20 |
| MRAH.K64C-G1T4 | 20 |
| MRAH.L63C-G1T4 | 20 |
| MRAH.S62C-G1T4 | 20 |
| MRAH.S52C-G1T4 | 20 |
| MRAH.I51C-G1T4 | 20 |
| MRAH.Y50C-G1T4 | 20 |
| MRAH.S35aC-G1T4 | 20 |
| MRAH.W35C-G1T4 | 20 |
| MRAH.S31C-G1T4 | 20 |
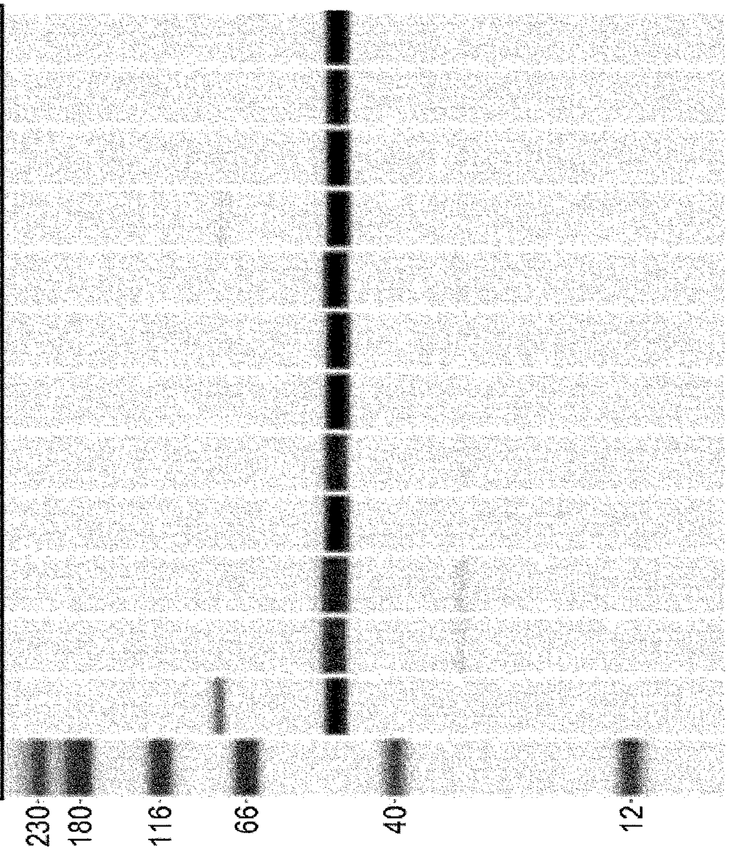

[Fig. 35]
| | |
|---|---|
| MRAL.R61C-k0 | 20 |
| MRAL.S60C-k0 | 20 |
| MRAL.V58C-k0 | 20 |
| MRAL.G57C-k0 | 20 |
| MRAL.T22C-k0 | 20 |
| MRAL.I21C-k0 | 20 |
| MRAL.T20C-k0 | 20 |
| MRAL.V19C-k0 | 20 |
| MRAL.R18C-k0 | 20 |
| MRAL.D17C-k0 | 20 |
| MRAL.G16C-k0 | 20 |
| MRAL.V15C-k0 | 20 |
| MRAL.S14C-k0 | 20 |
| MRAL.A13C-k0 | 20 |
| MRAL.S12C-k0 | 20 |
| MRAL.L11C-k0 | 20 |
| MRAL.S10C-k0 | 20 |
| MRAL.S9C-k0 | 20 |
| MRAL.S7C-k0 | 20 |
| MRAL.T5C-k0 | 20 |
| MRA | 20 |
| Antibody name | Antibody concentration (μg/mL) |
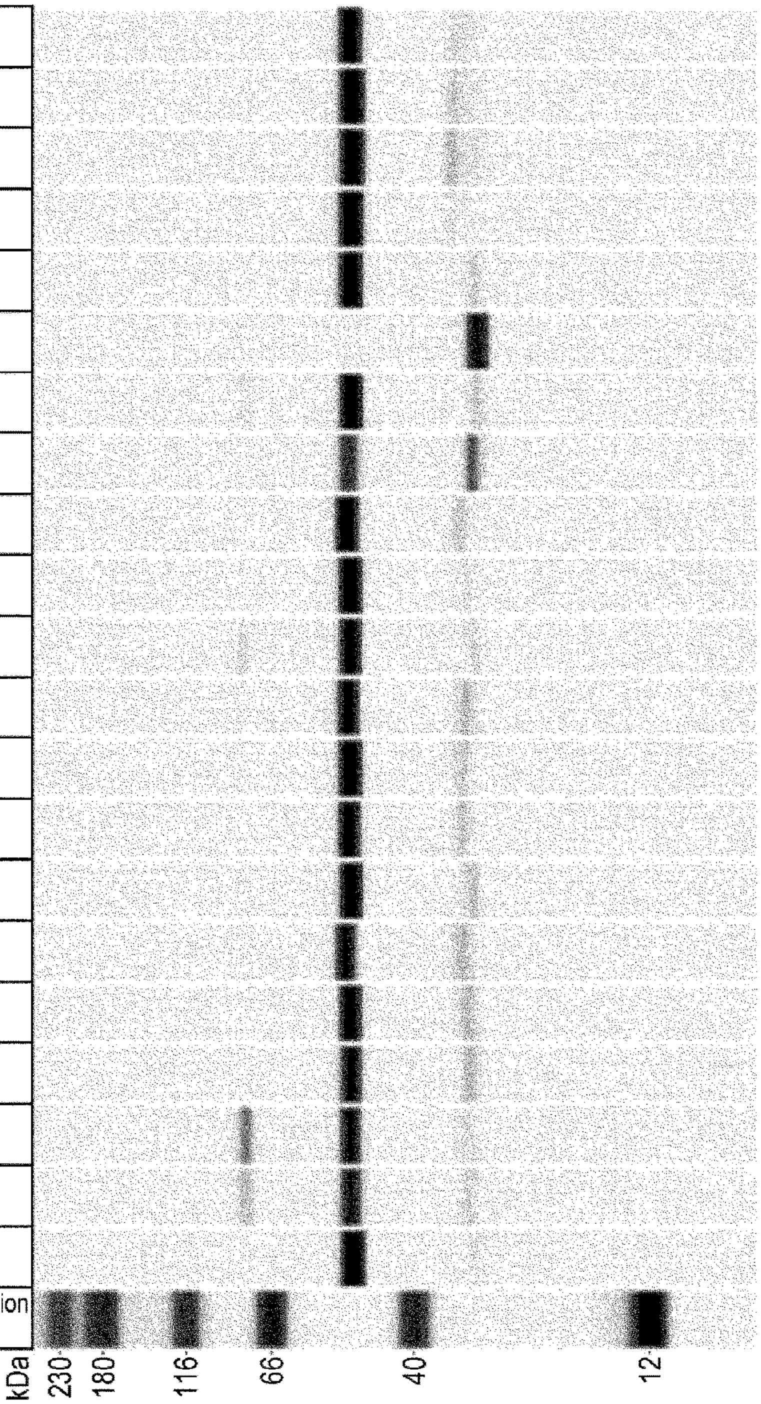

[Fig. 36]
| Antibody name | Antibody concentration (μg/mL) |
|---|---|
| MRAL.K107C-k0 | 20 |
| MRAL.I106C-k0 | 20 |
| MRAL.E105C-k0 | 20 |
| MRAL.V104C-k0 | 20 |
| MRAL.K103C-k0 | 20 |
| MRAL.T102C-k0 | 20 |
| MRAL.Q100C-k0 | 20 |
| MRAL.G99C-k0 | 20 |
| MRAL.F98C-k0 | 20 |
| MRAL.Q79C-k0 | 20 |
| MRAL.L78C-k0 | 20 |
| MRAL.S77C-k0 | 20 |
| MRAL.S76C-k0 | 20 |
| MRAL.T74C-k0 | 20 |
| MRAL.F73C-k0 | 20 |
| MRAL.T72C-k0 | 20 |
| MRAL.D70C-k0 | 20 |
| MRAL.T69C-k0 | 20 |
| MRAL.G68C-k0 | 20 |
| MRAL.S67C-k0 | 20 |
| MRAL.S65C-k0 | 20 |
| MRAL.S63C-k0 | 20 |
| MRAL.F62C-k0 | 20 |
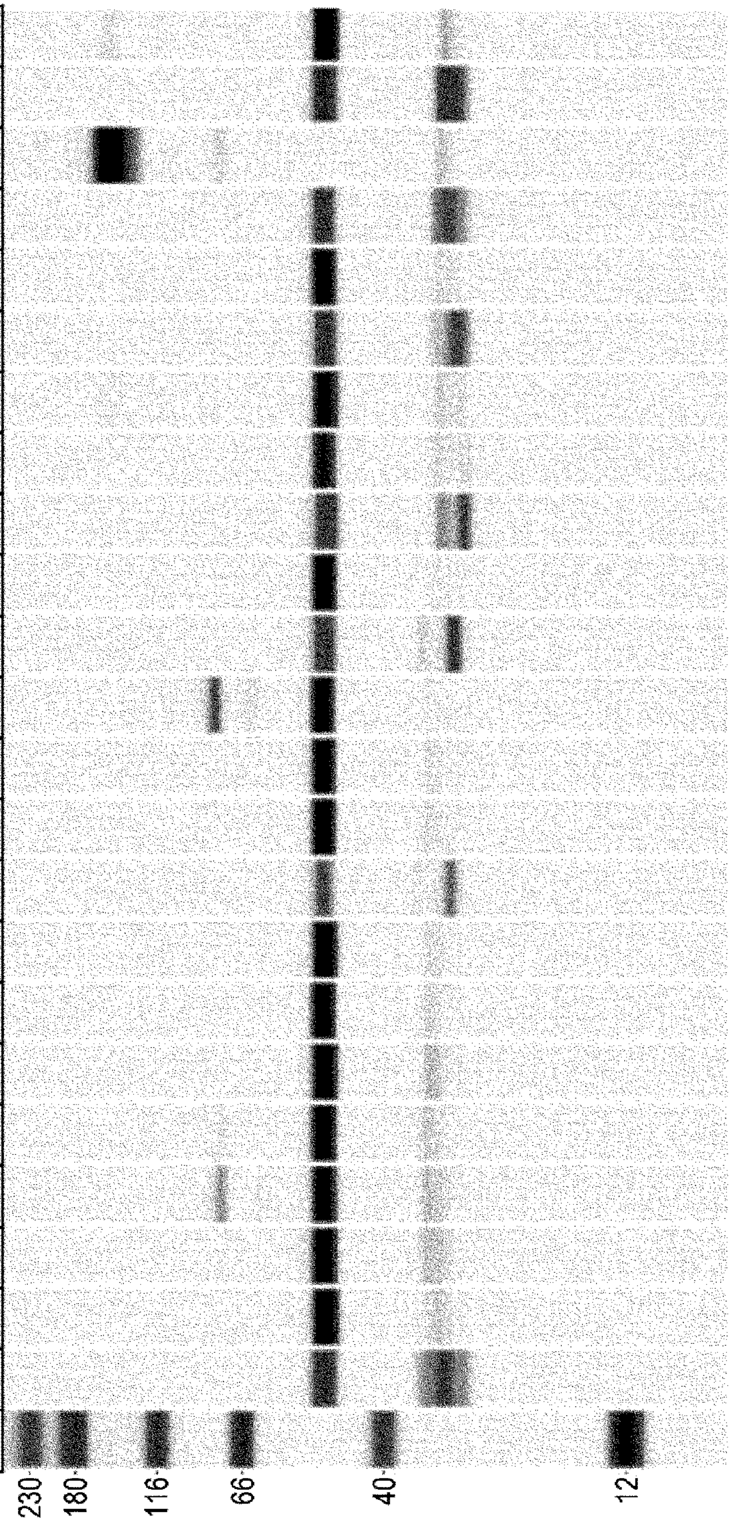

[Fig. 37]
| Antibody name | Antibody concentration (μg/mL) |
|---|---|
| MRAL-k0.S127C | 20 |
| MRAL-k0.K126C | 20 |
| MRAL-k0.L125C | 20 |
| MRAL-k0.Q124C | 20 |
| MRAL-k0.E123C | 20 |
| MRAL-k0.D122C | 20 |
| MRAL-k0.S121C | 20 |
| MRAL-k0.P120C | 20 |
| MRAL-k0.F116C | 20 |
| MRAL-k0.V115C | 20 |
| MRAL-k0.S114C | 20 |
| MRAL-k0.A112C | 20 |
| MRAL-k0.A111C | 20 |
| MRAL-k0.V110C | 20 |
| MRAL-k0.T109C | 20 |
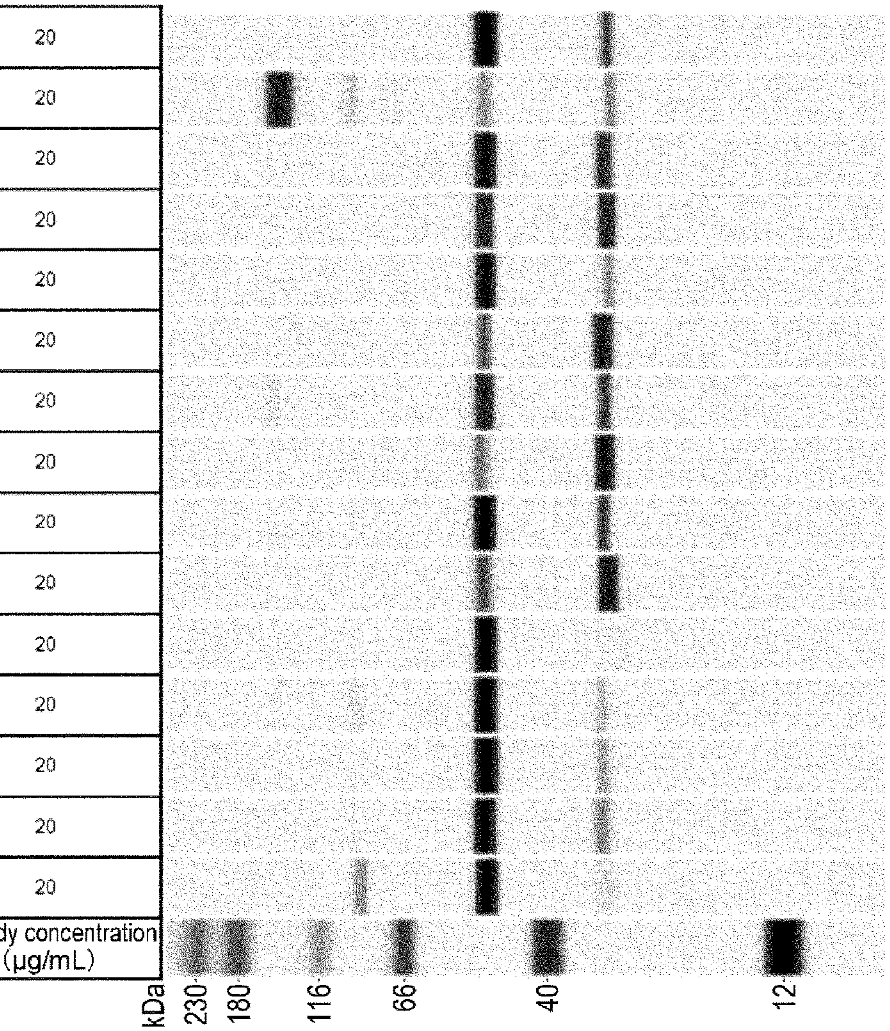

[Fig. 38]
| | |
|---|---|
| MRAL-k0.G157C | 20 |
| MRAL-k0.S156C | 20 |
| MRAL-k0.Q155C | 20 |
| MRAL-k0.L154C | 20 |
| MRAL-k0.A153C | 20 |
| MRAL-k0.N152C | 20 |
| MRAL-k0.D151C | 20 |
| MRAL-k0.V150C | 20 |
| MRAL-k0.K149C | 20 |
| MRAL-k0.Q147C | 20 |
| MRAL-k0.V146C | 20 |
| MRAL-k0.K145C | 20 |
| MRAL-k0.A144C | 20 |
| MRAL-k0.E143C | 20 |
| MRAL-k0.R142C | 20 |
| MRAL-k0.P141C | 20 |
| MRAL-k0.Y140C | 20 |
| MRAL-k0.F139C | 20 |
| MRAL-k0.N138C | 20 |
| MRAL-k0.N137C | 20 |
| MRAL-k0.L136C | 20 |
| MRAL-k0.S131C | 20 |
| MRAL-k0.T129C | 20 |
| MRAL-k0.G128C | 20 |
| Antibody name | Antibody concentration (μg/mL) |
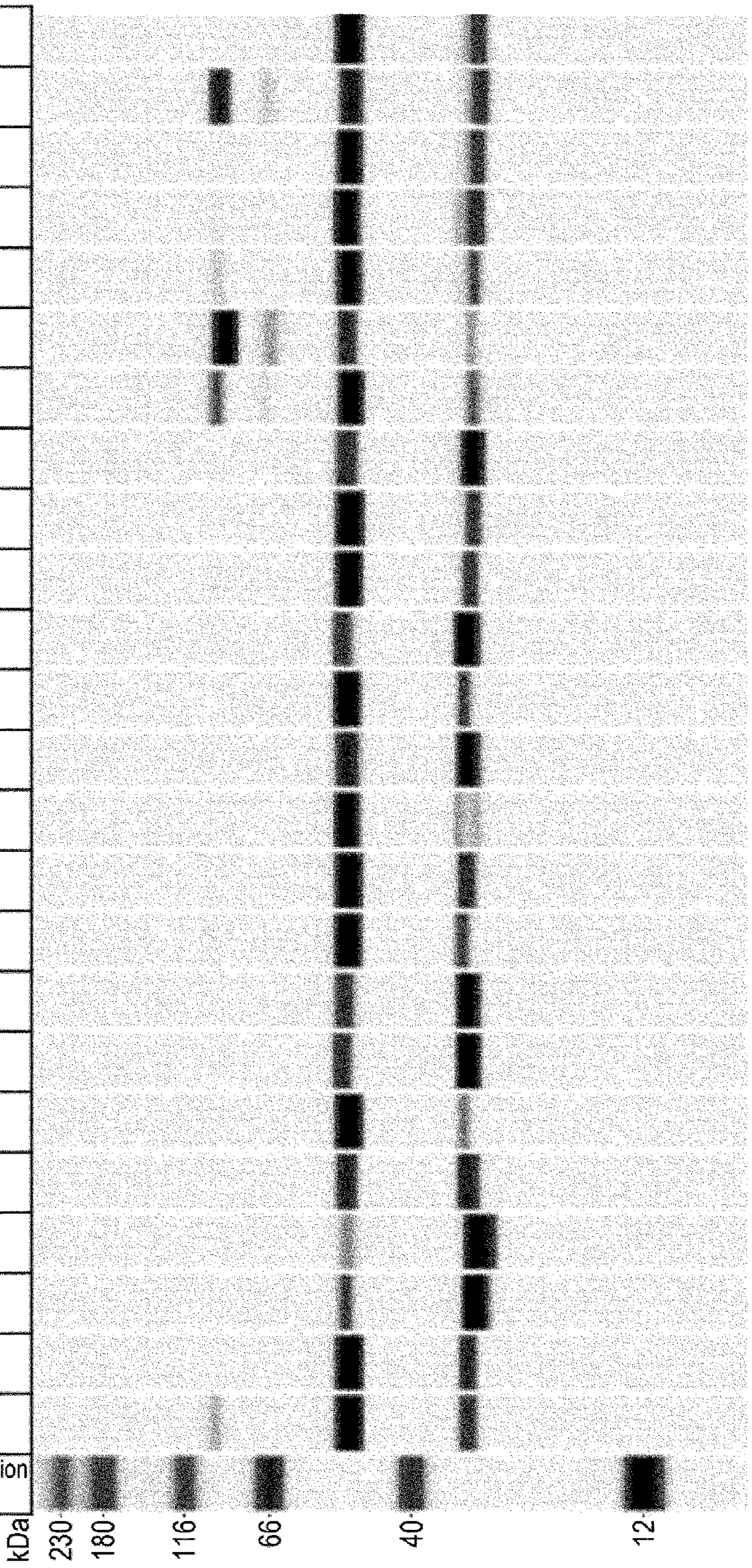

[Fig. 39]
| Antibody name | Antibody concentration (μg/mL) |
|---|---|
| MRA | 20 |
| MRAL-k0.T180C | 20 |
| MRAL-k0.L175C | 20 |
| MRAL-k0.S174C | 20 |
| MRAL-k0.T172C | 20 |
| MRAL-k0.S171C | 20 |
| MRAL-k0.D170C | 20 |
| MRAL-k0.K169C | 20 |
| MRAL-k0.S168C | 20 |
| MRAL-k0.D167C | 20 |
| MRAL-k0.Q166C | 20 |
| MRAL-k0.E165C | 20 |
| MRAL-k0.T164C | 20 |
| MRAL-k0.V163C | 20 |
| MRAL-k0.S162C | 20 |
| MRAL-k0.E161C | 20 |
| MRAL-k0.Q160C | 20 |
| MRAL-k0.S159C | 20 |
| MRAL-k0.N158C | 20 |
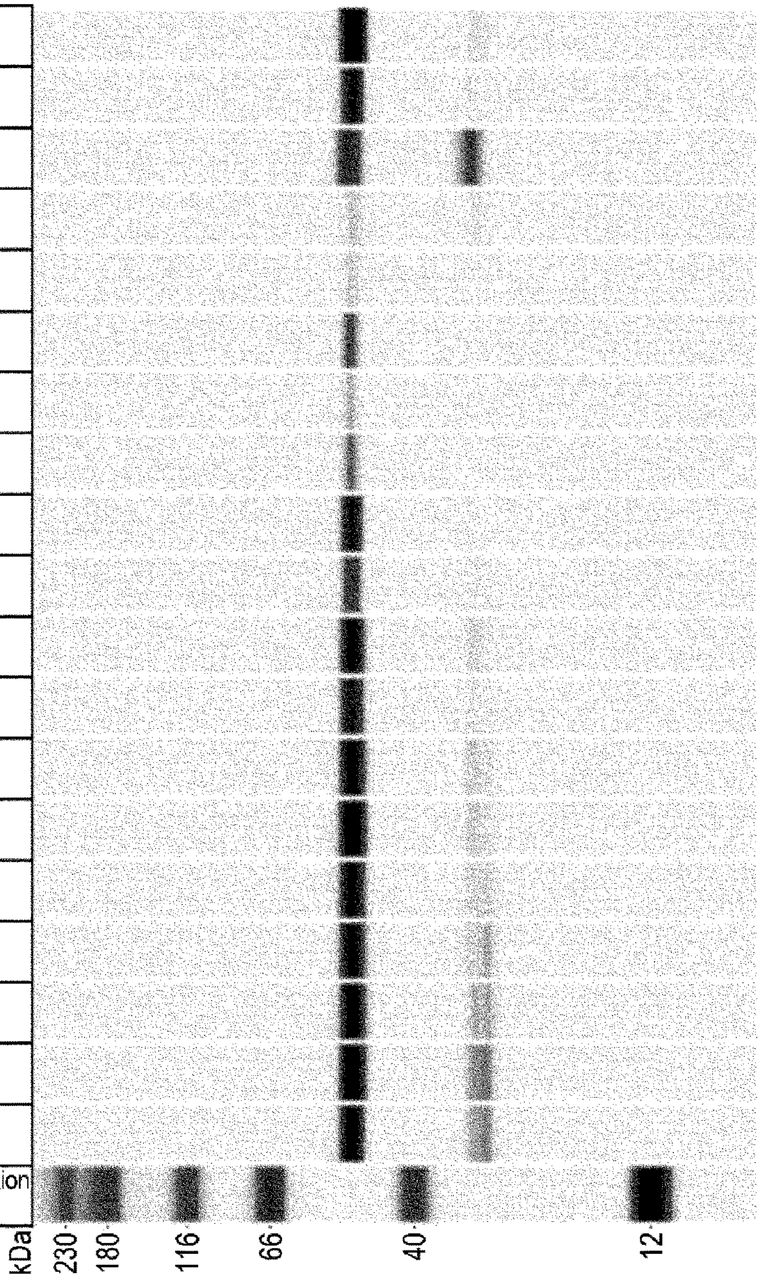

[Fig. 40]
| | |
|---|---|
| MRAL-k0.T206C | 20 |
| MRAL-k0.V205C | 20 |
| MRAL-k0.P204C | 20 |
| MRAL-k0.S203C | 20 |
| MRAL-k0.S202C | 20 |
| MRAL-k0.L201C | 20 |
| MRAL-k0.G200C | 20 |
| MRAL-k0.Q199C | 20 |
| MRAL-k0.H198C | 20 |
| MRAL-k0.T197C | 20 |
| MRAL-k0.V196C | 20 |
| MRAL-k0.E195C | 20 |
| MRAL-k0.A193C | 20 |
| MRAL-k0.Y192C | 20 |
| MRAL-k0.V191C | 20 |
| MRAL-k0.K190C | 20 |
| MRAL-k0.H189C | 20 |
| MRAL-k0.K188C | 20 |
| MRAL-k0.E187C | 20 |
| MRAL-k0.Y186C | 20 |
| MRAL-k0.D185C | 20 |
| MRAL-k0.A184C | 20 |
| MRAL-k0.K183C | 20 |
| MRAL-k0.S182C | 20 |
| Antibody name | Antibody concentration (μg/mL) |
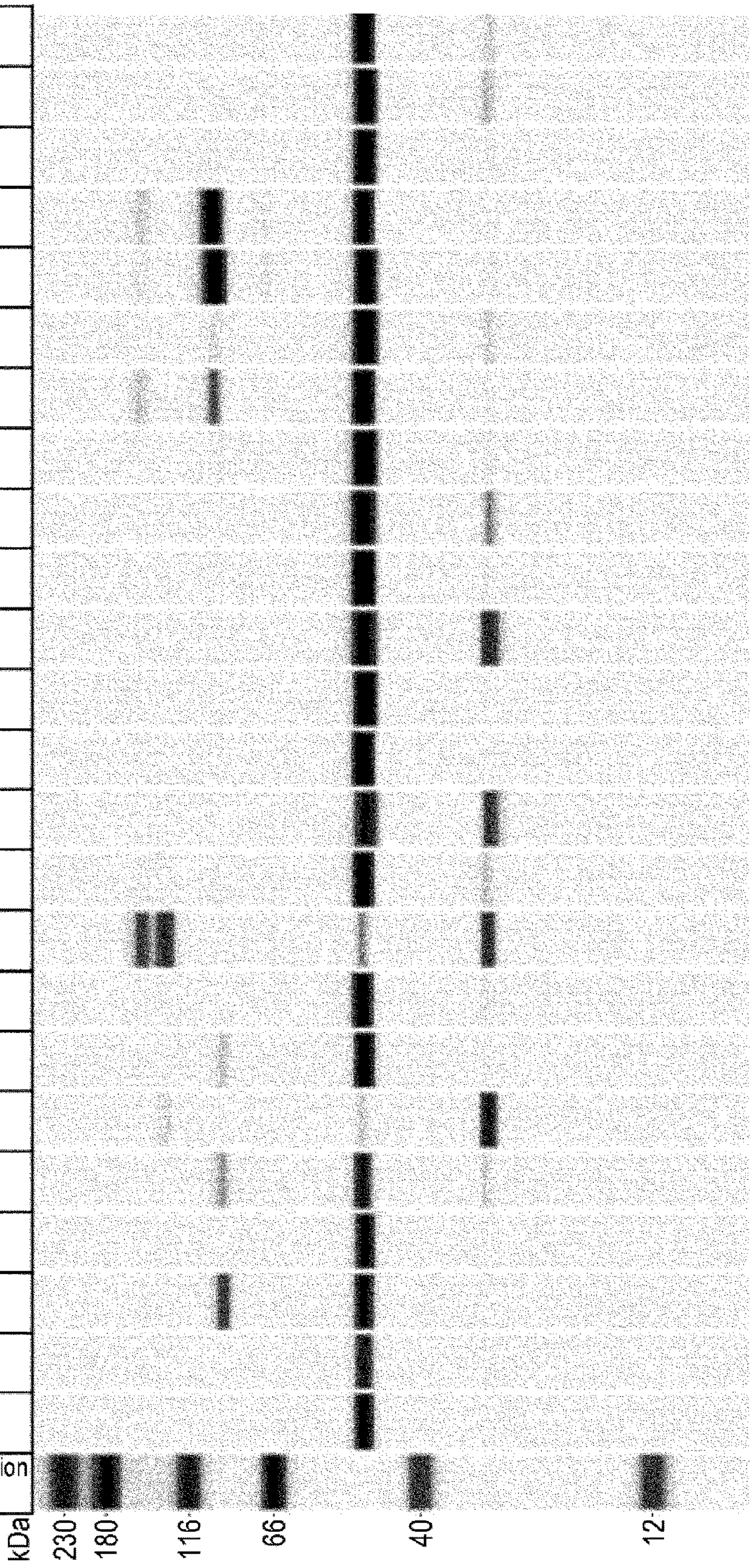

[Fig. 41]
| Antibody name | Antibody concentration (μg/mL) |
|---|---|
| MRAL-k0.L181C | 20 |
| MRAL-k0.A130C | 20 |
| MRAL.P59C-k0 | 20 |
| MRAL.Q6C-k0 | 20 |
| MRAL-k0.G212C | 20 |
| MRAL-k0.R211C | 20 |
| MRAL-k0.N210C | 20 |
| MRAL-k0.F209C | 20 |
| MRAL-k0.S208C | 20 |
| MRAL-k0.K207C | 20 |
| MRA | 20 |
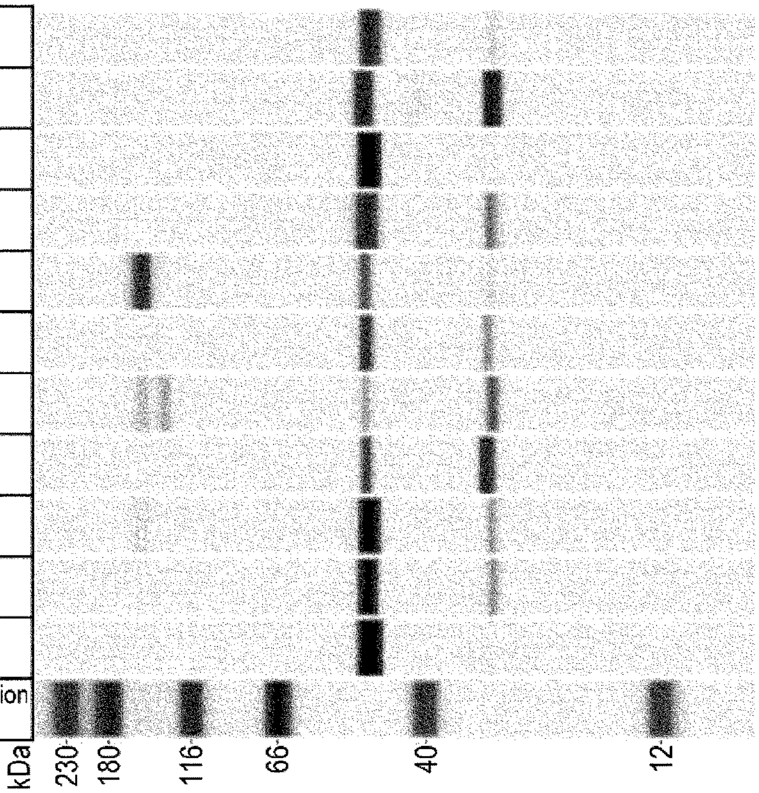
[Fig. 42]
| Antibody name | Antibody concentration (μg/mL) |
|---|---|
| MRAH-G1T4.S124C | 20 |
| MRA | 20 |
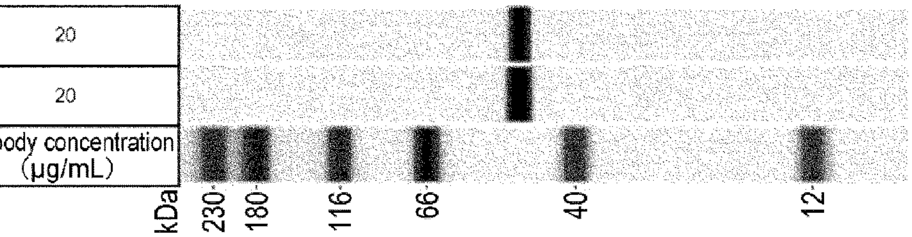

[Fig. 43]
| Antibody name | Antibody concentration (μg/mL) |
|---|---|
| MRAL.H55C-k0 | 20 |
| MRAL.T51C-k0 | 20 |
| MRAL.Y50C-k0 | 20 |
| MRAL.N34C-k0 | 20 |
| MRAL.L33C-k0 | 20 |
| MRAL.Y32C-k0 | 20 |
| MRAL.Q27C-k0 | 20 |
| MRAL.S26C-k0 | 20 |
| MRAL.A25C-k0 | 20 |
| MRAL-k0.E213C | 20 |
| MRAL-k0.H189C | 20 |
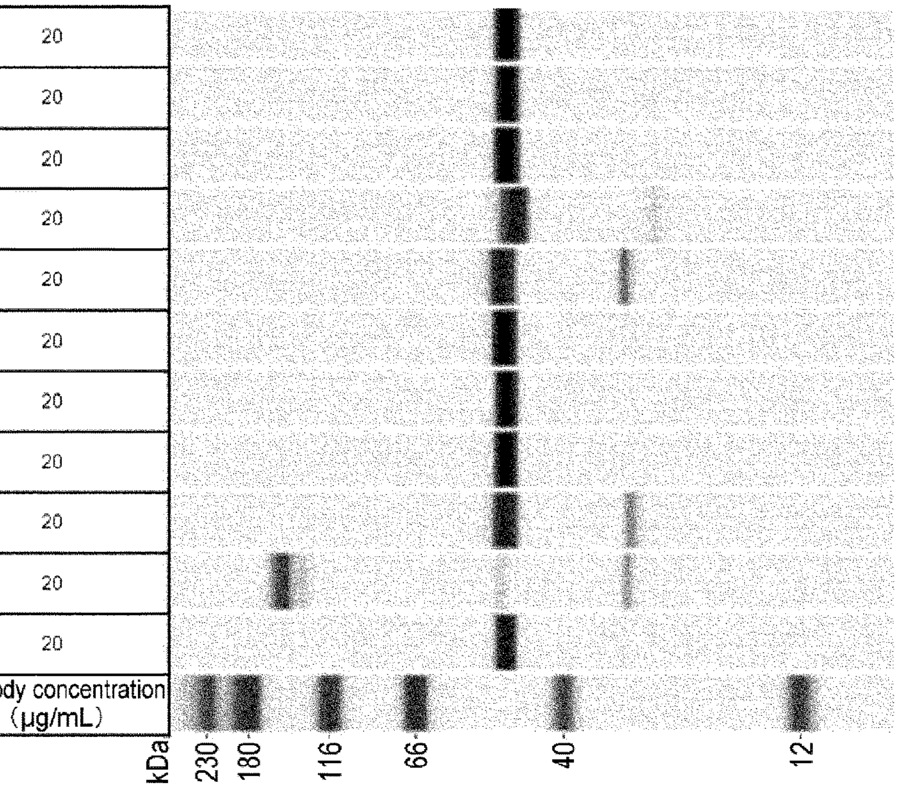
[Fig. 44]
| Antibody name | Antibody concentration (μg/mL) |
|---|---|
| MRA | 20 |
| MRAL.G101C-k0 | 20 |
| MRAL.T97C-k0 | 20 |
| MRAL.Y96C-k0 | 20 |
| MRAL.S56C-k0 | 20 |
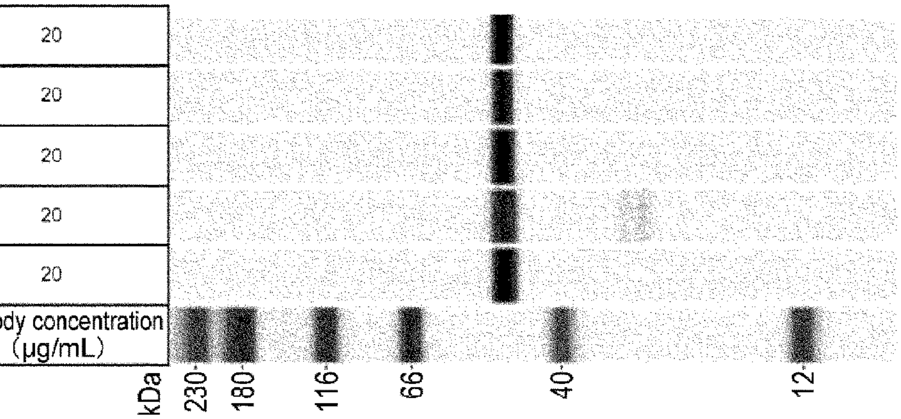

[Fig. 45]
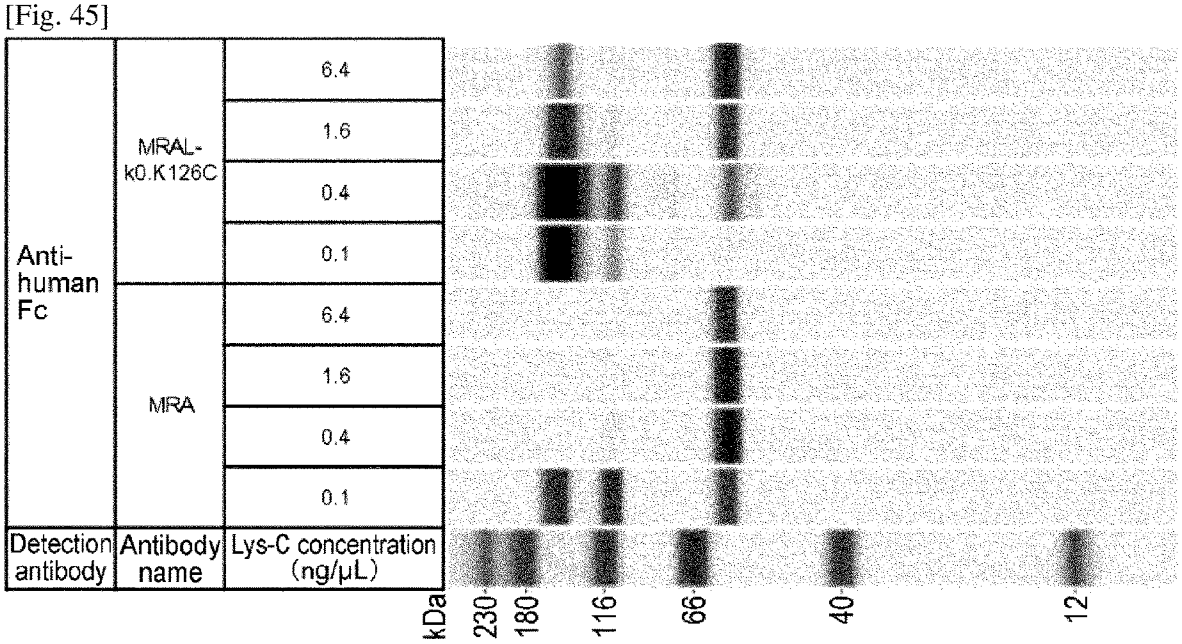
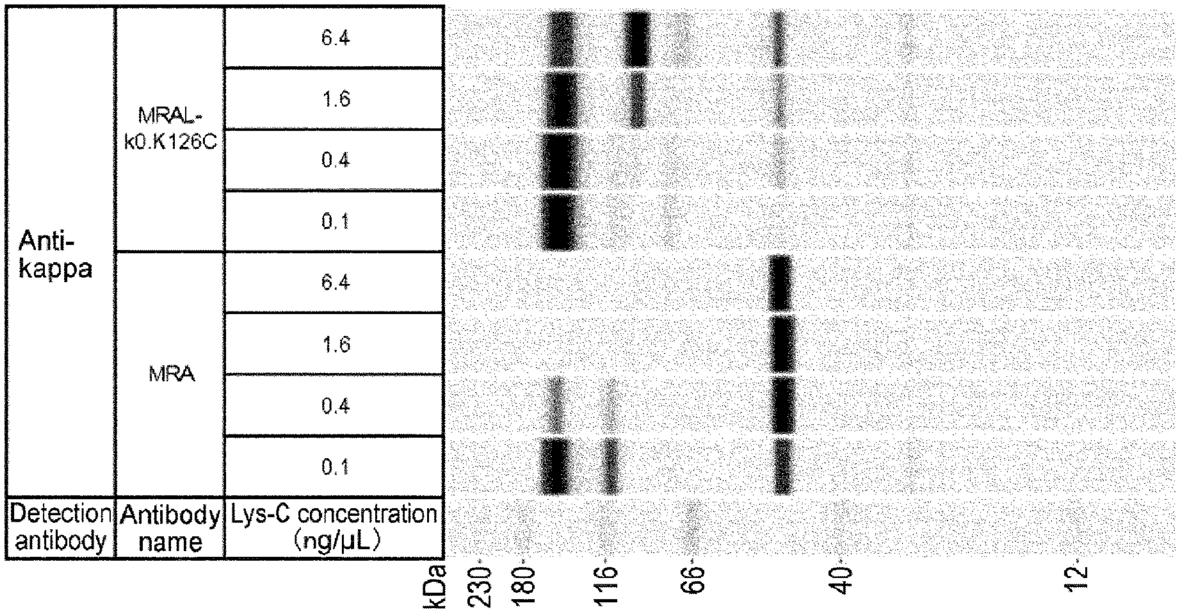
[Fig. 46]
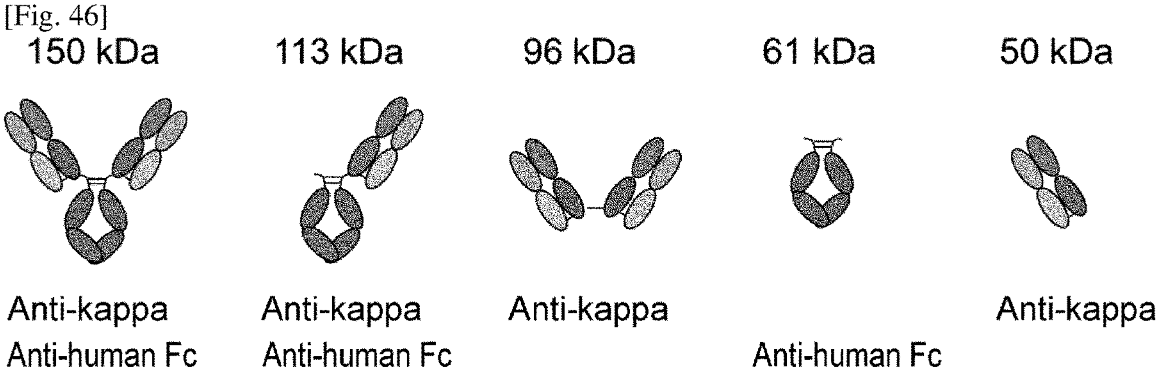

ANTIGEN-BINDING MOLECULE COMPRISING ALTERED ANTIBODY VARIABLE REGION

CROSS-REFERENCE TO RELATED APPLICATIONS

This application is the National Stage of International Application No. PCT/JP2019/038087, filed on Sep. 27, 2019, which claims the benefit of Japanese Application No. 2018-185120, filed on Sep. 28, 2018.

Sequence Listing

This application contains a Sequence Listing that has been submitted electronically as an ASCII text file named SequenceListing.txt. The ASCII text file, created on Mar. 4, 2021, is 797,899 bytes in size. The material in the ASCII text file is hereby incorporated by reference in its entirety.

TECHNICAL FIELD

The present invention provides antigen-binding molecules capable of modulating and/or activating an immune response; pharmaceutical compositions comprising any of the antigen-binding molecules; and methods for producing the antigen-binding molecules.

BACKGROUND ART

Antibodies have received attention as drugs because of having high stability in plasma and producing few adverse reactions (Nat. Biotechnol. (2005) 23, 1073-1078 (NPL 1) and Eur J Pharm Biopharm. (2005) 59 (3), 389-396 (NPL 2)). The antibodies not only have an antigen-binding effect and an agonist or antagonist effect, but induce cytotoxic activity mediated by effector cells (also referred to as effector functions), such as ADCC (antibody dependent cytotoxicity), ADCP (antibody dependent cell phagocytosis), or CDC (complement dependent cytotoxicity). Particularly, antibodies of IgG1 subclass exhibit the effector functions for cancer cells. Therefore, a large number of antibody drugs have been developed in the field of oncology.

For exerting the ADCC, ADCP, or CDC of the antibodies, their Fc regions must bind to antibody receptors (Fc gamma R) present on effector cells (such as NK cells or macrophages) and various complement components. In humans, Fc gamma RIa, Fc gamma RIIa. Fc gamma RIIb, Fc gamma RIIIa, and Fc gamma RIIIb isoforms have been reported as the protein family of Fe gamma R, and their respective allotypes have also been reported (Immunol. Lett. (2002) 82, 57-65 (NPL 3)). Of these isoforms. Fc gamma RIa, Fc gamma RIIa, and Fc gamma RIIIa have, in their intracellular domains, a domain called ITAM (immunoreceptor tyrosine-based activation motif), which transduces activation signals By contrast, only Fe gamma RIIb has, in its intracellular domain, a domain called ITIM (immunoreceptor tyrosine-based inhibitory motif), which transduces inhibition signals. These isoforms of Fc gamma R are all known to transduce signals through cross-linking by immune complexes or the like (Nat. Rev. Immunol. (2008) 8. 34-47 (NPL 4)). In fact, when the antibodies exert effector functions against cancer cells. Fc gamma R molecules on effector cell membranes are clustered by the Fc regions of a plurality of antibodies bound onto cancer cell membranes and thereby transduce activation signals through the effector cells. As a result, a cell-killing effect is exerted. In this respect, the cross-linking of Fc gamma R is restricted to effector cells located near the cancer cells, showing that the activation of immunity is localized to the cancer cells (Ann. Rev. Immunol. (1988). 6. 251-81 (NPL 5)).

Naturally occurring immunoglobulins bind to antigens through their variable regions and bind to receptors such as Fc gamma R, FcRn, Fc alpha R, and Fc epsilon R or complements through their constant regions. Each molecule of FcRn (binding molecule that interacts with an IgG Fc region) binds to each heavy chain of an antibody in a one-to-one connection. Hence, two molecules of FcRn reportedly bind to one IgG-type antibody molecule. Unlike FeRn, etc., Fc gamma R interacts with an antibody hinge region and CH2 domains, and only one molecule of Fc gamma R binds to one IgG-type antibody molecule (J. Bio. Chem., (20001) 276, 16469-16477). For the binding between Fc gamma R and the Fc region of an antibody, some amino acid residues in the hinge region and the CH2 domains of the antibody and sugar chains added to Asn 297 (EU numbering) of the CH2 domains have been found to be important (Chem. Immunol. (1997), 65, 88-110 (NPL 6), Eur. J. Immunol. (1993) 23, 1098-1104 (NPL 7), and Immunol. (1995) 86, 319-324 (NPL 8)). Fc region variants having various Fc gamma R-binding properties have previously been studied by focusing on this binding site, to yield Fc region variants having higher binding activity against activating Fe gamma R (WO2000/042072 (PTL 1) and WO2006/019447 (PTL 2)). For example. Lazar et al. have successfully increased the binding activity of human IgG1 against human Fc gamma RIIIa (V158) to approximately 370 times by substituting Ser 239, Ala 330, and Ile 332 (EU numbering) of the human IgG1 by Asn, Leu, and Glu, respectively (Proc. Natl. Acad. Sci. U.S.A. (2006) 103, 4005-4010 (NPL 9) and WO2006/019447 (PTL 2)).

This altered form has approximately 9 times the binding activity of a wild type in terms of the ratio of Fc gamma RIIIa to Fe gamma IIb (A/I ratio). Alternatively, Shinkawa et al. have successfully increased binding activity against Fc gamma RIIIa to approximately 100 times by deleting fucose of the sugar chains added to Asn 297 (EU numbering) (J. Biol. Chem. (2003) 278, 3466-3473 (NPL 10)). These methods can drastically improve the ADCC activity of human IgG1 compared with naturally occurring human IgG1.

A naturally occurring IgG-type antibody typically recognizes and binds to one epitope through its variable region (Fab) and can therefore bind to only one antigen. Meanwhile, many types of proteins are known to participate in cancer or inflammation, and these proteins may crosstalk with each other. For example, some inflammatory cytokines (TNF, IL1, and IL6) are known to participate in immunological disease (Nat. Biotech., (2011) 28, 502-10 (NPL 11)). Also, the activation of other receptors is known as one mechanism underlying the acquisition of drug resistance by cancer (Endocr Relat Cancer (2006) 13, 45-51 (NPL 12)). In such a case, the usual antibody, which recognizes one epitope, cannot inhibit a plurality of proteins.

Antibodies that bind to two or more types of antigens by one molecule (these antibodies are referred to as bispecific antibodies) have been studied as molecules inhibiting a plurality of targets. Binding activity against two different antigens (first antigen and second antigen) can be conferred by the modification of naturally occurring IgG-type antibodies (mAbs. (2012) Mar. 1, 4 (2)). Therefore, such an antibody has not only the effect of neutralizing these two or more types of antigens by one molecule but the effect of enhancing antitumor activity through the cross-linking of cells having cytotoxic activity to cancer cells. A molecule with an antigen-binding site added to the N or C terminus of an antibody (DVD-Ig, TCB and scFv-IgG), a molecule having different sequences of two Fab regions of an antibody (common L-chain bispecific antibody and hybrid hybridoma), a molecule in which one Fab region recognizes two antigens (two-in-one IgG and DutaMab), and a molecule having a CH3 domain loop as another antigen-binding site (Fcab) have previously been reported as molecular forms of the bispecific antibody (Nat. Rev. (2010), 10, 301-316 (NPL 13) and Peds (2010), 23 (4), 289-297 (NPL 14)) Since any of these bispecific antibodies interact at their Fc regions with Fc gamma R, antibody effector functions are preserved therein.

Provided that all the antigens recognized by the bispecific antibody are antigens specifically expressed in cancer, the bispecific antibody binding to any of the antigens exhibits cytotoxic activity against cancer cells and can therefore be expected to have a more efficient anticancer effect than that of the conventional antibody drug that recognizes one antigen. However, in the case where any one of the antigens recognized by the bispecific antibody is expressed in a normal tissue or is a cell expressed on immunocytes, damage on the normal tissue or release of cytokines occurs due to cross-linking with Fc gamma R (J. Immunol. (1999) Aug. 1, 163 (3), 1246-52 (NPL 15)). As a result, strong adverse reactions are induced.

For example, catumaxomab is known as a bispecific antibody that recognizes a protein expressed on T cells and a protein expressed on cancer cells (cancer antigen). Catumaxomab binds, at two Fabs, the cancer antigen (EpCAM) and a CD3 epsilon chain expressed on T cells, respectively Catumaxomab induces T cell-mediated cytotoxic activity through binding to the cancer antigen and the CD3 epsilon at the same time and induces NK cell-or antigen-presenting cell (e.g., macrophage)-mediated cytotoxic activity through binding to the cancer antigen and Fc gamma R at the same time. By use of these two cytotoxic activities, catumaxomab exhibits a high therapeutic effect on malignant ascites by intraperitoneal administration and has thus been approved in Europe (Cancer Treat Rev. (2010) October 36 (6), 458-67 (NPL 16)). In addition, the administration of catumaxomab reportedly yields cancer cell-reactive antibodies in some cases, demonstrating that acquired immunity is induced (Future Oncol. (2012) Jan. 8 (1), 73-85 (NPL 17)). From this result, such antibodies having both of T cell-mediated cytotoxic activity and the effect brought about by cells such as NK cells or macrophages via Fc gamma R (these antibodies are particularly referred to as trifunctional antibodies) have received attention because a strong antitumor effect and induction of acquired immunity can be expected.

The trifunctional antibodies, however, bind to CD3 epsilon and Fc gamma R at the same time even in the absence of a cancer antigen and therefore cross-link CD3 epsilon-expressing T cells to Fc gamma R-expressing cells even in a cancer cell-free environment to produce various cytokines in large amounts. Such cancer antigen-independent induction of production of various cytokines restricts the current administration of the trifunctional antibodies to an intraperitoneal route (Cancer Treat Rev. 2010 October 36 (6), 458-67 (NPL 16)). The trifunctional antibodies are very difficult to administer systemically due to serious cytokine storm-like adverse reactions (Cancer Immunol Immunother. 2007 September; 56 (9): 1397-406 (NPL 18)).

The bispecific antibody of the conventional technique is capable of binding to both antigens, i.e., a first antigen cancer antigen (EpCAM) and a second antigen CD3 epsilon, at the same time with binding to Fc gamma R, and therefore, cannot circumvent, in view of its molecular structure, such adverse reactions caused by the binding to Fe gamma R and the second antigen CD3 epsilon at the same time.

In recent years, a modified antibody that causes cytotoxic activity mediated by T cells while circumventing adverse reactions has been provided by use of an Fc region having reduced binding activity against Fc gamma R (WO2012/073985).

Even such an antibody, however, fails to act on two immunoreceptors, i.e., CD3 epsilon and Fc gamma R, while binding to the cancer antigen, in view of its molecular structure and it has proven to not be sufficiently effective because they could use only one immunoreceptors (WO2014/116846 (PTL 4)). Furthermore, very severe adverse event caused by cytokine release, called as cytokine release syndrome (CRS) or cytokine storm, is known to occur by such a bispecific antibody which act on only CD3 epsilon and it has been reported that the induction of IL-6 would be one of the main causes of CRS (Ferran, 1990. Eur J Immunol, March; 20 (3): 509-15. (NPL 26). Frey, 2016, Hematology Am Soc Hematol Educ Program. 2; 2016 (1): 567-572. (NPL 27).

T cells play important roles in tumor immunity, and are known to be activated by two signals: 1) binding of a T cell receptor (TCR) to an antigenic peptide presented by major histocompatibility complex (MHC) class I molecules and activation of TCR; and 2) binding of a costimulator on the surface of T cells to the ligands on antigen-presenting cells and activation of the costimulator. Furthermore, activation of molecules belonging to the tumor necrosis factor (TNF) superfamily and the TNF receptor superfamily, such as CD137 (4-1BB) on the surface of T cells, has been described as important for T cell activation (Vinay, 2011. Cellular & Molecular Immunology, 8, 281-284 (NPL 19)).

CD137 agonist antibodies have already been demonstrated to show anti-tumor effects, and this has been shown experimentally to be mainly due to activation of CD8-positive T cells and NK cells (Houot, 2009. Blood, 114, 3431-8 (NPL 20)). It is also understood that T cells engineered to have chimeric antigen receptor molecules (CAR-T cells) which consist of a tumor antigen-binding domain as an extracellular domain and the CD3 and CD137 signal transducing domains as intracellular domains can enhance the persistence of the efficacy (Porter. N ENGL J MED, 2011, 365:725-733 (NPL 21)). However, side effects of such CD137 agonist antibodies due to their non-specific hepatotoxicity have been a problem clinically and non-clinically, and development of pharmaceutical agents has not advanced (Dubrot, Cancer Immunol. Immunother., 2010, 28, 512-22 (NPL 22)). The main cause of the side effects has been suggested to involve binding of the antibody to the Fc gamma receptor via the antibody constant region (Schabowsky, Vaccine, 2009, 28, 512-22 (NPL 23)).

Furthermore, it has been reported that for agonist antibodies targeting receptors that belong to the TNF receptor superfamily to exert an agonist activity in vivo, antibody crosslinking by Fc gamma receptor-expressing cells (Fc gamma RII-expressing cells) is necessary (Li, Proc Natl Acad Sci USA. 2013, 110 (48), 19501-6 (NPL 24)).

WO2015/156268 (PTL 3) describes that a bispecific antibody which has a binding domain with CD137 agonistic activity and a binding domain to a tumor specific antigen can exert CD137 agonistic activity and activate immune cells only in the presence of cells expressing the tumor specific antigen, by which hepatotoxic adverse events of CD137 agonist antibody can be avoided while retaining the antitumor activity of the antibody. WO2015/156268 further describes that the anti-tumor activity can be further enhanced and these adverse events can be avoided by using this bispecific antibody in combination with another bispecific antibody which has a binding domain with CD3 agonistic activity and a binding domain to a tumor specific antigen. A tri-specific antibody which has three binding domains to CD137, CD3 and a tumor specific antigen (EGFR) has also been reported (WO2014/116846 (PTL 4)).

CITATION LIST

Patent Literature

[PTL 1] WO2000/042072
[PTL 2] WO2006/019447
[PTL 3] WO2015/156268
[PTL 4] WO2014/116846

Non Patent Literature

[NPL 1] Nat. Biotechnol. (2005) 23, 1073-1078
[NPL 2] Eur J Pharm Biopharm. (2005) 59 (3), 389-396
[NPL 3] Immunol. Lett. (2002) 82, 57-65
[NPL 4] Nat. Rev. Immunol. (2008) 8, 34-47
[NPL 5] Ann. Rev. Immunol. (1988), 6, 251-81
[NPL 6] Chem. Immunol. (1997), 65, 88-110
[NPL 7] Eur. J. Immunol. (1993) 23, 1098-1104
[NPL 8] Immunol. (1995) 86, 319-324
[NPL 9] Proc. Natl. Acad. Sci. U.S.A. (2006) 103, 4005-4010
[NPL 10] J. Biol. Chem. (2003) 278, 3466-3473
[NPL 11] Nat. Biotech., (2011) 28, 502-10
[NPL 12] Endocr Relat Cancer (2006) 13, 45-51
[NPL 13] Nat. Rev. (2010), 10, 301-316
[NPL 14] Peds (2010), 23 (4), 289-297
[NPL 15] J. Immunol. (1999) Aug. 1, 163 (3), 1246-52
[NPL 16] Cancer Treat Rev. (2010) October 36 (6), 458-67
[NPL 17] Future Oncol. (2012) Jan. 8 (1), 73-85
[NPL 18] Cancer Immunol Immunother, 2007 September; 56 (9): 1397-406
[NPL 19] Vinay, 2011, Cellular & Molecular Immunology, 8, 281-284
[NPL 20] Houot, 2009, Blood. 114, 3431-8
[NPL 21] Porter, N ENGL J MED, 2011, 365:725-733
[NPL 22] Dubrot, Cancer Immunol. Immunother., 2010, 28, 512-22
[NPL 23] Schabowsky, Vaccine, 2009, 28, 512-22
[NPL 24] Li, Proc Natl Acad Sci USA. 2013, 110 (48), 19501-6
[NPL 25] Clackson et al., Nature 352:624-628 (1991)
[NPL 26] Ferran et al, Eur J Immunol 20 (3): 509-15 (1990)
[NPL 27] Frey et al, Hematology Am Soc Hematol Educ Program 2016 (1): 567-572

SUMMARY OF INVENTION

Technical Problem

An antibody that exerts both cytotoxic activity mediated by immune cells (e.g. T cells) and activating activity of T cells and/or other immune cells via costimulatory molecules (e.g. CD137) in a target antigen-specific manner while circumventing adverse reactions has not yet been known.

An objective of the present invention is to provide an antigen-binding molecules which exhibit effective target-specific cell killing efficacy mediated by immune cells (e.g. T cells) while having reduced or minimal side effects. Another objective of the present invention is to provide a pharmaceutical composition comprising the antigen-binding molecule, and a method for producing the antigen-binding molecule.

Solution to Problem

Antigen-binding molecule capable of binding to multiple different antigens (e.g., CD3 on T cells, and CD137 on T cells, NK cells, DC cells, and/or the like), but do not non-specifically crosslink two or more immune cells such as T cells are provided. Such multispecific antigen-binding molecules are capable of modulating and/or activating an immune response while circumventing the cross-linking between different cells (e.g., different T cells) resulting from the binding of a conventional multispecific antigen-binding molecule to antigens expressed on the different cells, which is considered to be responsible for adverse reactions when the multispecific antigen-binding molecule is used as a drug.

In one aspect, the antigen-binding molecule of the present invention provides new antigen-binding molecules which have very unique structure format(s), which improve or enhance the efficacy of the multispecific antigen-binding molecules. The new antigen-binding molecules with unique structure formats provide the increased number of antigen-binding domains to give the increased valency and/or specificities to respective antigens on effector cells and target cells with the reduced unwanted adverse effects.

In a further aspect, one of the antigen-binding molecule having such new unique structure format of the present invention comprises at least two first and second antigen-binding domains (e.g., Fab domains) which are linked together (e.g., via Fc, disulfide bond, linker, or the like), each of which binds to a first and/or second antigen on effector cells (e.g., immune cells such as T cells. NK cells, DC cells, or the like) and further comprises a third (and optionally a fourth) antigen-binding domain(s) which is linked to any one of the first or second antigen-binding domain, which bind(s) to the third antigen on target cells (e.g., tumor cells).

In a further aspect, one of the antigen-binding molecule having such new unique structure format of the present invention comprises at least two first and second antigen-binding domains (e.g., Fab domains) which are linked together (e.g., via Fc, disulfide bond, linker, or the like), each of which binds to a first and/or second antigen on effector cells (e.g., immune cells such as T cells, NK cells, DC cells, or the like) and further comprises a third (and optionally the fourth) antigen-binding domain(s) which is linked to any one of the first or second antigen-binding domain, which bind(s) to the third antigen on target cells (e.g., tumor cells), wherein the first and second antigen-binding domains (e.g. Fab domains) capable of binding to the first antigen and/or a second antigen comprise at least one amino acid mutation(s) respectively, which create a linkage between the first and second antigen-binding domains to hold them close to each other, and, for example, promote cis-antigen binding to the same single effector cell.

The antigen-binding molecules having such unique structure formats that the inventors of the present invention were surprisingly found to show superior efficacy while exhibiting reduced or minimal off-target side-effects attributed by undesired cross-linking among different cells (e.g., effector cells such as T cells).

More specifically, the present invention relates to the followings.

[1] An antigen-binding molecule comprising at least two antigen-binding domains, which comprises;

(i) a first antigen-binding domain comprising a heavy chain variable (VH) region and a light chain variable (VL) region; and (ii) a second antigen-binding domain comprising a heavy chain variable (VH) region and a light chain variable (VL) region, wherein the first antigen-binding domain and the second antigen-binding domain are linked via a Fc region, a disulfide bond or a linker, wherein the first antigen-binding domain and the second antigen-binding domain are respectively capable of binding to a first antigen and a second antigen which is different from the first antigen, but do not bind to both of the first and second antigens at the same time.

[2] The antigen-binding molecule of [1], which further comprises a third antigen-binding domain comprising a heavy chain variable (VH) region and a light chain variable (VL) region, which is capable of binding to a third antigen which is different from the first antigen and the second antigen, wherein the third antigen-binding domain is linked to any one of the first antigen-binding domain and the second antigen-binding domain, or a Fc region.

[3] An antigen-binding molecule comprising at least two antigen binding-domains, which comprises;

(i) a first antigen-binding domain comprising a heavy chain variable (VH) region and a light chain variable (VL) region; and (ii) a second antigen-binding domain comprising a heavy chain variable (VH) region and a light chain variable (VL) region, wherein the first antigen-binding domain and the second antigen-binding domain are linked via a Fc region, a disulfide bond or a linker, wherein the first antigen-binding domain is capable of binding to a first antigen and a second antigen which is different from the first antigen, but does not bind to both of the first and second antigens at the same time; and wherein the second antigen-binding domain is capable of binding to only either one of the first antigen or second antigen.

[4] The antigen-binding molecule of [3], which further comprises a third antigen-binding domain comprising a heavy chain variable (VH) region and a light chain variable (VL) region, which is capable of binding to a third antigen which is different from the first antigen and the second antigens.

wherein the third antigen-binding domain is linked to any one of the first antigen-binding domain and the second antigen-binding domain, or a Fc region.

[5] An antigen-binding molecule comprising at least two antigen-binding domains, which comprises;

(i) a first antigen-binding domain comprising a heavy chain variable (VH) region and a light chain variable (VL) region; and (ii) a third antigen-binding domain comprising a heavy chain variable (VH) region and a light chain variable (VL) region, and wherein the third antigen-binding domain has linked to the first antigen-binding domain, wherein the first antigen-binding domain is capable of binding to a first antigen and a second antigen which is different from the first antigen, but does not bind to both of the first and second antigens at the same time; and wherein the third antigen-binding domain is capable of binding to a third antigen which is different from the first antigen and the second antigen.

[6] An antigen-binding molecule comprising at least two antigen-binding domains, which comprises;

(i) a first antigen-binding domain comprising a heavy chain variable (VH) region and a light chain variable (VL) region; and (ii) a second antigen-binding domain comprising a heavy chain variable (VH) region and a light chain variable (VL) region, wherein the first antigen-binding domain and the second antigen-binding domain are linked via a Fc region, a disulfide bond or a linker, wherein the first antigen-binding domain and the second antigen-binding domain are respectively capable of binding to only either one of a first antigen or a second antigen.

[7] The antigen-binding molecule of [6], which further comprises a third antigen-binding domain comprising a heavy chain variable (VH) region and a light chain variable (VL) region, which is capable of binding to a third antigen which is different from the first antigen and the second antigens, wherein the third antigen-binding domain has linked to any one of the first antigen-binding domain and the second antigen-binding domain, or a Fc region.

[7A] An antigen-binding molecule as represented by the formula:

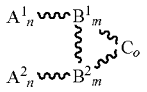

wherein C is a Fc region;

O is an integer of 1 or 0;

each of $B^1$ and $B^2$ is;

(i) a first antigen binding domain and a second antigen-binding domain, each is capable of binding to a first antigen and a second antigen which is different from the first antigen, but does not bind to both antigens at the same time, (ii) a first antigen binding domain and a second antigen-binding domain, wherein one antigen binding domain is capable of binding to a first antigen and a second antigen which is different from the first antigen, but does not bind to both antigens at the same time, and the other antigen binding domain is capable of binding to only either one of the first antigen or the second antigen;

(iii) a first antigen binding domain and a second antigen-binding domain, each is capable of binding to a first antigen; or (iv) a first antigen binding domain and a second antigen-binding domain, wherein the first antigen-binding domain and the second antigen-binding domain are respectively capable of binding to only either one of a first antigen or a second antigen; m of each $B^1$ and $B^2$ is an integer of 1 or 0, provided that both m are not 0 at the same time;

each of $A^1$ and $A^2$ is;

(i) a same antigen binding domain that is capable of binding to a third antigen which is different from the first antigen and the second antigen;

(ii) a different antigen binding domain, wherein one antigen binding domain is capable of binding to a third antigen which is different from the first antigen and the second antigen, and the other antigen binding domain is capable of a fourth antigen which is different from the first antigen, the second antigen and the third antigen;

n of each A1 and A2 is an integer of 1 or 0, provided that n is 0 in case that m is 0; and each of a wavy line between $B^1$ and C, and $B^2$ and C is a covalent bond or a linker;

each of a wavy line of $B^1$ and $A^1$, and $B^2$ and $A^2$ is a covalent bond or a linker; and a wavy line between B1 and B2 is one or more bonds which hold the $B^1$ and $B^2$ close to each other, provided that: in case that B1 and B2 each comprises an antibody heavy chain hinge region, and B1 and B2 are linked each other by one or more native disulfide bonds in the respective binge regions, said bond is a bond which is present between any other portions than the hinge regions, or an additional bond which is present between the hinge regions.

[8] The antigen-binding molecule of any one of [1] to [5], wherein any one or more of the first antigen-binding domain and the second antigen binding domain which is/are capable of binding to a first antigen and a second antigen which is different from the first antigen, but does not bind to both of the first and second antigens at the same time, have alteration of at least one amino acid.

[9] The antigen-binding molecule of [8], wherein the alteration is substitution, insertion, or deletion of at least one amino acid.

[10] The antigen-binding molecule of [9], wherein the alteration is substitution of a portion of the amino acid sequence of a VH and/or VL regions binding to the first antigen by an amino acid sequence of a VH and/or VL regions binding to the second antigen, or insertion of an amino acid sequence of a VH and/or VL regions binding to the second antigen into the amino acid sequence of a VH and/or VL regions binding to the first antigen.

[11] The antigen-binding molecule of any one of [9] or [10], wherein the number of amino acids to be inserted or substituted is 1 to 25.

[12] The antigen-binding molecule of any one of [8] to [11], wherein the amino acid to be altered is an amino acid in one or more of CDR1, CDR2, CDR3, and FR3 regions of the heavy chain variable (VH) region and/or light chain variable (VL) region.

[13] The antigen-binding molecule of any one of [8] to [12], wherein the amino acid to be altered is an amino acid in a loop of one or more of hyper variable region (HVR).

[14] The antigen-binding molecule of any one of [8] to [13], wherein the amino acid to be altered is at least one amino acid selected from Kabat numbering positions 31 to 35, 50 to 65, 71 to 74, and 95 to 102 in an antibody heavy chain variable (VH) region, and Kabat numbering positions 24 to 34, 50 to 56, and 89 to 97 in an light chain variable (VL) region.

[15] The antigen-binding molecule of any one of [1] to [14], wherein the first antigen-binding domain and the second antigen-binding domain are linked via a Fc region.

[16] The antigen-binding molecule of [15], wherein the Fc region is a Fc region having reduced binding activity against Fc gamma R as compared with that of the Fc region of a wild-type human IgG1 antibody.

[17] The antigen-binding molecule of any one of [1] to [14], wherein the first antigen-binding domain and the second antigen-binding domain each comprises a hinge region and are linked via one or more disulfide bond(s) in the hinge regions.

[18] The antigen-binding molecule of any one of [1] to [14], wherein the first antigen-binding domain and the second antigen-binding domain are linked via a linker

[19] The antigen-binding molecule of any one of [1] to [14], wherein each of the antigen-binding domain has a Fab, Fab', scFab, Fv, scFv, or VHH structure.

[20] The antigen-binding molecule of any one of [1] to [14], wherein each of the antigen-binding domain has a Fab.

[21] The antigen-binding molecule of any one of [1] to [20], wherein each of the first antigen-binding domain and the second antigen-binding domain comprises a Fab and a hinge region, together forming a F(ab')2 structure.

[22] Then antigen-binding molecule of any one of [2], [4]. [5] and [7] to [21], wherein the third antigen-binding domain has linked to either of the first antigen-biding domain or the second antigen-binding domain through the linkage of any of the following;

(i) between a C-terminus of a poly peptide comprising the heavy chain variable (VH) region of the third antigen-binding domain and a N-terminus of a polypeptide comprising the heavy chain variable (VH) region of either of the first antigen-biding domain or the second antigen-binding domain, (ii) between a C-terminus of a polypeptide comprising the heavy chain variable (VH) region of the third antigen-binding domain and a N-terminus of a polypeptide comprising the light chain variable (VL) region of either of the first antigen-biding domain or the second antigen-binding domain, (iii) between a C-terminus of a polypeptide comprising the light chain variable (VL) region of the third antigen-binding domain and a N-terminus of a polypeptide comprising the heavy chain variable (VH) region of either of the first antigen-biding domain or the second antigen-binding domain, or (iv) between a C-terminus of a polypeptide comprising the light chain variable (VL) region of the third antigen-binding domain and a N-terminus of a polypeptide comprising the light chain variable (VL) region of either of the first antigen-biding domain or the second antigen-binding domain.

The antigen-binding molecule according to [1]-[22], wherein the first antigen-binding domain and the second antigen-binding domain are linked with each other via at least one bond which holds the first antigen-binding domain and the second antigen-binding domain close to each other, provided that, in case that the first antigen-binding domain comprises a heavy chain hinge region and the second antigen-binding domain comprises a heavy chain hinge region respectively, and the first antigen-binding domain and the second antigen-binding domain are linked each other by one or more native disulfide bonds in the respective hinge regions, said bond is a bond which is present between any other portions than the hinge regions, or an additional bond which is present between the hinge regions.

[23A] The antigen-binding molecule according to [1]-[23], wherein the at least one bond which hold(s) the first antigen-binding domain and the second antigen-binding domain close to each other restrict(s) the antigen binding of the first antigen-binding domain and the second antigen-binding domain to cis-antigen binding (i.e. binding to antigens on the same cell).

[24] The antigen-binding molecule according to [23], wherein the at least one bond is a covalent bond.

[25] The antigen-binding molecule of [24], wherein the covalent bond is formed by direct crosslinking of an amino acid residue in the first antigen-binding domain and an amino acid residue in the second antigen-binding domain.

[26] The antigen-binding molecule of [25], wherein the crosslinked amino acid residues are cysteine.

[27] The antigen-binding molecule of [26], wherein the formed covalent bond is a disulfide bond.

[28] The antigen-binding molecule of [24], wherein the covalent bond is formed by crosslinking of an amino acid residue in the first antigen-binding domain and an amino acid residue in the second antigen-binding domain via a crosslinking agent.

[29] The antigen-binding molecule of [28], wherein the crosslinking agent is an amine-reactive crosslinking agent.

[30] The antigen-binding molecule of [29], wherein the crosslinked amino acid residues are lysine.

[31] The antigen-binding molecule of [23], wherein the at least one bond is a noncovalent bond.

[32] The antigen-binding molecule of [31], wherein the noncovalent bond is an ionic bond, hydrogen bond, or hydrophobic bond.

[33] The antigen-binding molecule of any one of [23] to [32], wherein the first antigen-binding domain comprises a heavy chain variable (VH) region and a CH1 region, and a light chain variable (VL) region and a light chain constant region (CL), and the second antigen-binding domain comprises a heavy chain variable (VH) region and a CH1 region and a light chain variable (VL) region and a light chain constant region (CL), and wherein the at least one bond is present between an amino acid residue in the CH1 region of the first antigen-binding domain and an amino acid residue in the CH1 region of the second antigen-binding domain.

[34] The antigen-binding molecule of [33], wherein said amino acid residue is present at a position selected from the group consisting of positions 119, 122, 123, 131, 132, 133, 134, 135, 136, 137, 139, 140, 148, 150, 155, 156, 157, 159, 160, 161, 162, 163, 165, 167, 174, 176, 177, 178, 190, 191, 192, 194, 195, 197, 213, and 214 according to EU numbering in the CH1 region.

[35] The antigen-binding molecule of [34], wherein said amino acid residue is present at position 191 according to EU numbering in the CH1 region.

[36] The antigen-binding molecule of [35], wherein the amino acid residue at position 191 according to EU numbering in the respective CH1 region of the first antigen-binding domain and the second antigen-binding domain are linked with each other to form a bond.

[37] The antigen-binding molecule of any one of [23] to [32], wherein the first antigen-binding domain comprises a heavy chain variable (VH) region, a CH1 region and a hinge region, and a light chain variable (VL) region and a light chain constant region, and the second antigen-binding domain comprises a heavy chain variable (VH) region, a CH1 region and a hinge region, and a light chain variable (VL) region and a light chain constant region, and wherein the at least one bond is present between an amino acid residue in the hinge region of the first antigen-binding domain and an amino acid residue in the hinge region of the second antigen-binding domain.

[38] The antigen-binding molecule of [37], wherein said amino acid residue is present at a position selected from the group consisting of positions 216, 218, and 219 according to EU numbering in the hinge region.

[39] The antigen-binding molecule of any one of [23] to [32], wherein the first antigen-binding domain comprises a heavy chain variable (VH) region and a CH1 region, and a light chain variable (VL) region and a light chain constant region (CL), and the second antigen-binding domain comprises a heavy chain variable (VH) region and a CH1 region and a light chain (VL) variable region and a light chain constant region (CL), and wherein the at least one bond is present between an amino acid residue in the CL region of the first antigen-binding domain and an amino acid residue in the CL region of the second antigen-binding domain.

[40] The antigen-binding molecule of [39], wherein said amino acid residue is present at a position selected from the group consisting of positions 109, 112, 121, 126, 128, 151, 152, 153, 156, 184, 186, 188, 190, 200, 201, 202, 203, 208, 210, 211, 212, and 213 according to EU numbering in the CL region.

[41] The antigen-binding molecule of [40], wherein said amino acid residue is present at position 126 according to EU numbering in the CL region.

[42] The antigen-binding molecule of [42], wherein the amino acid residues at position 126 according to EU numbering in the respective CL region of the first antigen-binding domain and the second antigen-binding domain are linked with each other to form a bond.

[43] The antigen-binding molecule of any one of [23] to [32], wherein the first antigen-binding domain comprises a heavy chain variable (VH) region and a CH1 region, and a light chain variable (VL) region and a light chain constant region (CL), and the second antigen-binding domain comprises a heavy chain variable (VH) region and a CH1 region and a light chain variable (VL) region and a light chain constant region (CL), and wherein the at least one bond is present between an amino acid residue in the CH1 region of the first antigen-binding domain and an amino acid residue in the CL region of the second antigen-binding domain are linked to form a bond.

[44] The antigen-binding molecule of any one of [23] to [32], wherein the first antigen-binding domain comprises a heavy chain variable (VH) region and a CH1 region, and a light chain variable (VL) region and a light chain constant region (CL), and the second antigen-binding domain comprises a heavy chain variable (VH) region and a CH1 region and a light chain variable (VL) region and a light chain constant region (CL), and wherein the at least one bond is present between an amino acid residue in the CH1 region of the second antigen-binding domain and an amino acid residue in the CL region of the first antigen-binding domain are linked to form a bond.

[45] The antigen-binding molecule of [43], wherein the amino acid residue at position 191 according to EU numbering in the CH1 region of the first antigen-binding domain and the amino acid residue at position 126 according to EU numbering in the CL region of the second antigen-binding domain are linked to form a bond.

[46] The antigen-binding molecule of [44], wherein the amino acid residue at position 191 according to EU numbering in the CH1 region of the second antigen-binding domain and the amino acid residue at position 126 according to EU numbering in the CL region of the first antigen-binding domain are linked to form a bond.

[47] The antigen-binding molecule of any one of [33] to [46], wherein the CH1 and/or the light chain constant region (CL) are derived from human.

[48] The antigen-binding molecule of any one of [33] to [46], wherein the subclass of the CH1 region is gamma 1, gamma 2, gamma 3, gamma 4, alpha J, alpha 2, mu, delta, or epsilon.

[49] The antigen-binding molecule of any one of [33] to [46], wherein the subclass of the CL region is kappa or lambda.

[50] The antigen-binding molecule of any one of [23] to [32], wherein at least one bond is present between an amino acid residue of in the heavy chain variable (VH) region or the light chain variable (VL) region of the first antigen-binding domain and an amino acid residue of in the heavy chain variable (VH) region or the light chain variable (VL) region of the second antigen-binding domain.

[51] The antigen-binding molecule of [50], wherein the at least one bond is present between an amino acid residue in the VH region of the first antigen-binding domain and an amino acid residue in the VH region of the second antigen-binding domain.

[52] The antigen-binding molecule of [51], wherein the amino acid residue is present at a position selected from the group consisting of positions 8, 16, 28, 74, and 82b according to Kabat numbering in the VH region.

[53] The antigen-binding molecule of [50], wherein the at least one bond is present between an amino acid residue in the VL region of the first antigen-binding domain and an amino acid residue in the VH region of the second antigen-binding domain.

[54] The antigen-binding molecule of [53], wherein said amino acid residue is present at a position selected from the group consisting of positions 100, 105, and 107 according to Kabat numbering in the VL region.

[55] The antigen-binding molecule according to any of [1] to [54], wherein the first antigen is a molecule specifically expressed on a T cell.

[56] The antigen-binding molecule of any one of [1] to [55], wherein the first antigen is a T cell receptor complex molecule.

[57] The antigen-binding molecule of any one of [1] to [56], wherein the first antigen is CD3, preferably human CD3.

[58] The antigen-binding molecule of any one of [1] to [57], wherein the second antigen is a molecule expressed on a T cell or any other immune cell.

[59] The antigen-binding molecule of any one of [1] to [58], wherein the second antigen is a costimulatory molecule expressed on a T cell or any other immune cell.

[60] The antigen-binding molecule of any one of [1] to [59], wherein the second antigen is a TNFR superfamily molecule.

[61] The antigen-binding molecule of any one of [1] to [60], wherein the second antigen is a CD137 (4-1BB).

[62] The antigen-binding molecule of any one of [1] to [61], wherein the first antigen is CD3 and the second antigen is CD137.

[63] The antigen-binding molecule of any one of [1] to [62], wherein the third antigen which is different from the first antigen and the second antigen is a molecule specifically expressed in a cancer cell.

[64] The antigen-binding molecule of any one of [1] to [63], wherein the third antigen which is different from the first antigen and the second antigen is Glypican-3 (GPC3).

[65] The antigen-binding molecule of any one of [1] to [64], wherein one or more of the first antigen-binding domain or the second antigen-binding domain comprise(s);

(a) a VH region comprising the sequence having at least 95% sequence identity to any one of the amino acid sequence of SEQ ID NO: 1-11 and 61; and (b) a VL region comprising the sequence having at least 95% sequence identity to any one of the amino acid sequence of SEQ ID NO: 45-48.

[65A] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 1; and (b) a VL region comprising the sequence having at least 95% sequence identity to the amino acid sequence of SEQ ID NO: 45.

[65B] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 2; and (b) a VL region comprising the sequence having at least 95% sequence identity to the amino acid sequence of SEQ ID NO: 46.

[65C] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 3; and (b) a VL region comprising the sequence having at least 95% sequence identity to the amino acid sequence of SEQ ID NO: 45.

[65D] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 4; and (b) a VL region comprising the sequence having at least 95% sequence identity to the amino acid sequence of SEQ ID NO: 45.

[65E] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 5; and (b) a VL region comprising the sequence having at least 95% sequence identity to the amino acid sequence of SEQ ID NO: 45.

[65F] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 6; and (b) a VL region comprising the sequence having at least 95% sequence identity to the amino acid sequence of SEQ ID NO: 45.

[65G] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 7; and (b) a VL region comprising the sequence having at least 95% sequence identity to the amino acid sequence of SEQ ID NO: 45.

[65H] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 8; and (b) a VL region comprising the sequence having at least 95% sequence identity to the amino acid sequence of SEQ ID NO: 45.

[65H] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 9; and (b) a VL region comprising the sequence having at least 95% sequence identity to the amino acid sequence of SEQ ID NO: 45.

[65I] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 10; and (b) a VL region comprising the sequence having at least 95% sequence identity to the amino acid sequence of SEQ ID NO: 45.

[65J] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 11; and (b) a VL region comprising the sequence having at least 95% sequence identity to the amino acid sequence of SEQ ID NO: 48.

[65K] The antigen-binding molecule of any one of [1] to [64], wherein one or more of the first antigen-binding domain or the second antigen-binding domain comprise(s);

(a) a VH region comprising the sequence having at least 95% sequence identity to the amino acid sequence of SEQ ID NO: 61; and (b) a VL region comprising the sequence having at least 95% sequence identity to the amino acid sequence of SEQ ID NO: 48.

[66] The antigen-binding molecule of any one of [1] to [64], wherein one or more of the first antigen-binding domain or the second antigen-binding domain compete (s) for binding with an antibody comprising:

(a) a VH region comprising the sequence having an amino acid sequence of any one of SEQ ID NO: 1-11 and 61; and (b) a VL region comprising the sequence having an amino acid sequence of any one of SEQ ID NO: 45-48.

[67] The antigen-binding molecule of any one of [1] to [64], wherein one or more of the first antigen-binding domain or the second antigen-binding domain bind(s) to the same epitope with an antibody comprising:

(a) a VH region comprising the sequence having an amino acid sequence of any one of SEQ ID NO: 1-11 and 61; and (b) a VL region comprising the sequence having an amino acid sequence of any one of SEQ ID NO: 45-48.

[68] The antigen-binding molecule of any one of [1] to [64], wherein one or more of the first antigen-binding domain or the second antigen-binding domain comprise(s);

(i) a VH region comprising:

(a) a HCDR1 sequence having at least 95% sequence identity to any one of the amino acid sequence of SEQ ID NO: 12-22 and 62;

(b) a HCDR2 sequence having at least 95% sequence identity to any one of the amino acid sequence of SEQ ID NO: 23-33 and 63; and/or (c) a HCDR3 sequence having at least 95% sequence identity to any one of the amino acid sequence of SEQ ID NO: 34-44 and 64; and/or (ii) a VL region comprising:

(d) a LCDR1 sequence having at least 95% sequence identity to any one of the amino acid sequence of SEQ ID NO: 49-52;

(c) a LCDR2 sequence having at least 95% sequence identity to any one of the amino acid sequence of SEQ ID NO: 53-54 and 56; and/or (f) a LCDR3 sequence having at least 95% sequence identity to any one of the amino acid sequence of SEQ ID NO: 57-58 and 60.

[68A] The antigen-binding molecule of any one of [1] to [64], wherein one or more of the first antigen-binding domain or the second antigen-binding domain comprise(s) a VH region comprising HCDR1-3 and a VL region comprising LCDR1-3 sequences as listed in Table 1.1.

[69] The antigen-binding molecule of any one of [1] to [64], comprising one or more of the following;

(a) a polypeptide chain comprising the amino acid sequences selected from the group consisting of SEQ ID NO: 67, 71, 73, 75, 78, 80 and 83,
(b) a polypeptide chain comprising the amino acid sequences selected from the group consisting of SEQ ID NO: 68 and 72;
(c) a polypeptide chain comprising the amino acid sequences selected from the group consisting of SEQ ID NO: 69, 74, 76, 79, 81 and 84; and
(d) a polypeptide chain comprising the amino acid sequences selected from the group consisting of SEQ ID NO: 70, 77 and 82.

[69A] The antigen-binding molecule of any one of [1] to [64], comprising polypeptide chains as listed in Table 2.2.

[70] A pharmaceutical composition that comprises the antigen-binding molecules of any one of [1] to and a pharmaceutically acceptable carrier.

[71] One or more polynucleotide(s) encoding one or more polypeptide of any one of the antigen-binding molecules of [1] to [69].

[72] One or more vector(s) comprising the polynucleotide of [71].

[73] A cell comprising the vector of [72].

[74] A method for producing an antigen-binding molecule, which comprises culturing the cell of and isolating the antigen-binding molecule from the culture supernatant.

[75] A method for producing an antigen-binding molecule comprising:
(a) providing one or more nucleic acids encoding one or more polypeptides forming a first antigen-binding domain and a second antigen-binding domain, wherein;
(i) the first antigen-binding domain and the second antigen-binding domain are respectively capable of binding to a first antigen and a second antigen which is different from the first antigen, but do not bind to both of the first and second antigens at the same time, or
(ii) the first antigen-binding domain is capable of binding to a first antigen and a second antigen which is different from the first antigen, but does not bind to both of the first and second antigens at the same time; and the second antigen-binding domain is capable of binding to only either one of the first antigen or second antigen; or
(iii) the first antigen-binding domain and the second antigen-binding domain are respectively capable of binding to only either one of a first antigen or a second antigen;
(b) introducing the nucleic acids in (a) into a host cell;
(c) culturing the host cell so that two or more polypeptides are produced; and
(d) obtaining the antigen-binding molecule.

[76] The method of [75], wherein the provision of the antigen-binding domain that does not bind to the first antigen and the second antigen at the same time as defined in the steps (i) and (ii) comprises:
preparing a library of antigen-binding domain with at least one amino acid altered in their heavy chain variable (VH) region and light chain variable (VL) region, each of which binds to the first antigen or the second antigen, wherein the altered variable regions differ in at least one amino acid from each other; and
selecting, from the prepared library, an antigen-binding domain comprising a heavy chain variable (VH) region and a light chain variable (VL) region that has binding activity against the first antigen and the second antigen, but does not bind to the first antigen and the second antigen at the same time.

[76A] The method of [76], wherein the alteration is alteration of at least one amino acid selected from Kabat numbering positions 31 to 35, 50 to 65, 71 to 74, and 95 to 102 in the heavy chain variable (VH) region, and Kabat numbering positions 24 to 34, 50 to 56, and 89 to 97 in the light chain variable (VL) region.

[76B] The method of any one of [75] to [76A], wherein the antigen-binding domain that does not bind to the first antigen and the second antigen at the same time as defined in (i) and (ii), is an antigen-binding domain that, at its own, does not bind to the first antigen and the second antigen each expressed on a different cell, at the same time.

[77] The method of any one of [75] to [76B], wherein step (a) further comprises providing one or more nucleic acids encoding one or more polypeptides comprising a third antigen-binding domain binding to a third antigen which is different from the first and second antigens.

[77A] The method of any one of [75] to [76B], wherein the host cell cultured in the step (c) further comprises a nucleic acid encoding an antibody Fc region.

[77B] The method of [77A], wherein the Fc region is an Fc region having reduced binding activity against Fc gamma R as compared with the Fc region of a naturally occurring human IgG1 antibody.

[78] The method of any one of [75] to [77B], wherein the first antigen-binding domain, the second antigen-binding domain and/or the third antigen-binding domain are encoded by one single nucleic acid.

[79] The method of any one of [75] to [78], wherein step (a) further comprises introducing one or more mutation into the nucleic acid sequence encoding each of the first and second antigen-binding domains which, when translated, introduces one or more bond linking the first and second antigen-binding domains close to each other.

[80] The method of [79], wherein the first antigen-binding domain and the second antigen-binding domain are linked with each other via at least one bond which holds the first antigen-binding domain and the second antigen-binding domain close to each other.
provided that, in case that the first antigen-binding domain comprises a heavy chain hinge region and the second antigen-binding domain comprises a heavy chain hinge region respectively, and the first antigen-binding domain and the second antigen-binding domain are linked each other by one or more native disulfide bonds in the respective hinge regions, said bond is a bond which is present between any other portions than the hinge regions, or an additional bond which is present between the hinge regions.

[81] The method of [79] or [80], wherein the first antigen-binding domain comprises a heavy chain variable (VH) region and a CH1 region, and a light chain variable (VL) region and a light chain constant region (CL), and the second antigen-binding domain comprises a heavy chain variable (VH) region and a CH1 region and a light chain variable (VL) region and a light chain constant region (CL), and
wherein the one or more mutation is present;
(i) in the CH1 region of the first antigen-binding domain and in the CH1 region of the second antigen-binding domain;

(ii) in the CH1 region of the first antigen-binding domain and in the CL region of the second antigen-binding domain;

(iii) in the CL region of the first antigen-binding domain and in the CH1 region of the second antigen-binding domain;

(iv) in the CL region of the first antigen-binding domain and in the CL region of the second antigen-binding domain, or (v) in the VH region or VL region of the first antigen-binding domain, and in the VH region or the VL region of the second antigen-binding domain.

[82] The method of any one of [79] to [81], wherein the one or more mutation is cysteine substitution or insertion.

[83] The method of any one of [79] to [81], wherein a cysteine amino acid residue is introduced at position 191 according to EU numbering in the respective CH1 region of the first antigen-binding domain and the second antigen-binding domain.

[84]] The method of any one of [79] to [83], further comprises: conducting an assay to determine whether the first antigen-binding domain and the second antigen domain respectively do not bind to the first antigen and the second antigen each expressed on a different cell, at the same time.

[85] The method of any one of [79] to [84], wherein the first antigen is a molecule specifically expressed on a T cell.

[86] The method of any one of [79] to [84], wherein the first antigen is a T cell receptor complex molecule.

[87] The method of any one of [79] to [86], wherein the first antigen is CD3, preferably human CD3.

[88] The method of any one of [75] to [87], wherein the second antigen is a molecule expressed on a T cell or any other immune cell.

[89] The method of any one of [75] to [88], wherein the second antigen is a costimulatory molecule expressed on a T cell or any other immune cell.

[90] The method of any one of [75] to [89], wherein the second antigen is a TNFR superfamily molecule.

[91] The method of any one of [75] to [90], wherein the second antigen is a CD137 (4-1BB).

[92] The method of any one of [75] to [91], wherein the first antigen is CD3 and the second antigen is CD137.

[93] The method of any one of [75] to [92], wherein the third antigen which is different from the first antigen and the second antigen is a molecule specifically expressed in a cancer cell.

[94] The method of any one of [75] to [93], wherein the third antigen which is different from the first antigen and the second antigen is Glypican-3 (GPC3).

BRIEF DESCRIPTION OF DRAWINGS

FIG. 1.1 A drawing showing results of measurement of CD137 agonistic activity of affinity matured GPC3/Dual-Ig variants trispecific antibodies, (a) Mean Luminescence units+/−standard deviation (s.d.) detected by SK-pca60 cell line co-cultured with Jurkat NF kappa B reporter cells overexpressing CD137 by a group of the selected antibodies, (b) Similar to (a), mean Luminescence units+/−standard deviation (s.d.) detected by SK-pca60 cell line co-cultured with Jurkat NF kappa B reporter cells overexpressing CD137 by other group of antibodies were analysed in a second plate.

FIG. 1.2 A drawing showing mean cytotoxicity (cell growth Inhibition (%) values+/−s.d.) of GPC3/Dual-Ig variants.

SK-pca60 was co-cultured with PBMC in the presence of selected GPC3/Dual-Ig trispecific molecules at 5 nM and 10 nM, E:T 0.5 and analysed using real-time xCELLigence system. Mean Cell Growth Inhibition (%) values+/−s.d. obtained at 120 h was plotted in graph shown.

FIG. 2.1 A drawing illustrating various antibody formats of the present invention.

Annotation of each Fv region corresponds to that indicating in Table 2.1. Diagram (a) depicts 1+2 format trivalent antibody, (b) depicts 1+2 trivalent antibody applied with line technology. (c) depicts 2Fab bivalent antibody format, and (d) depicts conventional IgG based bivalent antibody format.

FIG. 2.2.1 A drawing illustrating antibody formats and naming rule of sequence ID listed in Table 2.2 and Table 2.3.

FIG. 2.2.2 A drawing illustrating antibody formats and naming rule of sequence ID listed in Table 2.2 and Table 2.3.

FIG. 2.3 A drawing showing the results of evaluation of cytotoxicity of different antibody formats in GPC3-low expressing cancer cells, (a) Histogram from flow cytometric analysis of GPC3 expression (black sold line) in SK-pca60 (left panel), Huh7 (middle panel) and NCI-H446 (right panel) cell lines. Anti-KLH antibody was used as a control (grey filled histogram). Cytotoxicity comparing (b) shows comparison of cytotoxicity of GPC3/CD3 and GPC3/Dual in 1+1 format, while cytotoxicity comparing (c) shows comparison of cytotoxicity of 1+2 trivalent and 2Fab antibodies compared to 1+1 format antibody in low GPC3-expressing Huh7 (left panel) and NCI-H446 (right panel) cell lines. Tumor cell lines were co-cultured with PBMC at E:T ratio of 1. Acquisition of data was performed using xCELLigence system and values are indicated as mean+/−s.d. of percentage cell growth inhibition at 72 hours.

FIG. 3.1 A drawing schematically depicting an introduction of a crosslinking in 1+2 format such as GPC3-Dual/Dual antibody can reduce toxicity.

Linc-Ig can restrict binding primarily to cis mode on immune cells. In contrast, 1+2 trivalent format could result in trans mode between two immune cells independent of tumor antigen binding. This may cause cross-linking of two immune cells independent of tumor antigen binding which could increase toxicity.

FIG. 3.2 A drawing showing an antigen independent cytotoxicity on GPC3 negative cells in the presence of each antibody.

CHO overexpressing CD137 was co-cultured with purified in vitro activated T cells. E:T 5 for 48 h and analysed using LDH assay. Graph depicting mean cell lysis percentage+/−s.d. of different antibody formats incubated at 1.25, 5 and 20 nM.

FIG. 3.3 A graph of results of evaluation of cytotoxicity (cell growth inhibition) of different antibody formats in NCI-H446 cell line.

1+2 trivalent formats, with and without line technology showed stronger cytotoxicity than 1+1 format. NCI-H446 was co-cultured with PBMC at ET ratio of 0.5 with various antibody formats at 1, 3 and 10 nM. Acquisition of data was performed using xCELLigence system and values are indicated as mean+/−s.d. of percentage cell growth inhibition FIG. 3.4 A drawing showing results of evaluation of cytokine release by different antibody formats in NCI-H446 cell line evaluated in FIG. 3.3.

Graph shows mean concentration+/−s.d. of cytokines IFN gamma (top left). IL-2 (top right) and TNF alpha (bottom left). Supernatant of co-culture in FIG. 3.3 was analysed at 40 h timepoint that was co-cultured with PBMC. E:T 1.0. Antibodies were added at 0.6, 2.5 and 10 nM.

FIG. 4 A drawing showing a design of C3NP1-27, CD3 epsilon peptide antigen which is biotin-labeled through disulfide-bond linker.

FIG. 5 A graph showing the result of phage ELISA of clones obtained with phage display to CD3 and CD137.

Y axis means the specificity to CD137-Fc and X axis means the specificity to CD3 of each clone.

FIG. 6 A graph showing the result of phage ELISA of clones obtained with phage display to CD3 and CD137.

Y axis means the specificity to CD137-Fc in beads ELISA and X axis means the specificity to CD3 in plate ELISA as same as FIG. 5 of each clone.

FIG. 7 A drawing showing a comparison data of human CD137 amino acids sequence with cynomolgus monkey CD137 amino acids sequence.

FIG. 8 A graph showing the result of ELISA of IgGs obtained with phage display to CD3 and CD137.

Y axis means the specificity to cyno CD137-Fc and X axis means the specificity to human CD137 of each clone.

FIG. 9 A graph showing the result of ELISA of IgGs obtained with phage display to CD3 and CD137.

Y axis means the specificity to CD3e.

FIG. 10 A graph showing the result of competitive ELISA of IgGs obtained with phage display to CD3 and CD137.

Y axis means the response of ELISA to biotin-human CD137-Fc or biotin-human Fc. Excess amount of human CD3 or human Fc were used as competitor.

FIG. 11A A set of graphs showing the result of phage ELISA of phage display panning output pools to CD3 and CD137.

Y axis means the specificity to human CD137. X axis means the panning output pools, Primary is a pool before phage display panning, and R1 to R6 means panning output pool after phage display panning Round1 to Round6, respectively.

FIG. 11B A set of graphs showing the result of phage ELISA of phage display panning output pools to CD3 and CD137.

Y axis means the specificity to cyno CD137. X axis means the panning output pools, Primary is a pool before phage display panning, and R1 to R6 means panning output pool after phage display panning Round1 to Round6, respectively.

FIG. 11C A set of graphs showing the result of phage ELISA of phage display panning output pools to CD3 and CD137.

Y axis means the specificity to CD3. X axis means the panning output pools. Primary is a pool before phage display panning, and R1 to R6 means panning output pool after phage display panning Round1 to Round6, respectively.

FIG. 12.1 A set of graphs showing the result of ELISA of IgGs obtained with phage display to CD3 and CD137.

Y axis means the specificity to human CD137-Fc and X axis means the specificity to human CD137 or CD3 of each clone.

FIG. 12.2 A set of graphs showing the result of ELISA of IgGs obtained with phage display to CD3 and CD137. Y axis means the specificity to human CD137-Fc and X axis means the specificity to human CD137 or CD3 of each clone.

FIG. 12.3 A set of graphs showing the result of ELISA of IgGs obtained with phage display to CD3 and CD137. Y axis means the specificity to human CD137-Fc and X axis means the specificity to human CD137 or CD3 of each clone.

FIG. 13 A set of graphs showing the result of ELISA of IgGs obtained with phage display to CD3 and CD137.

Y axis means the specificity to human CD137-Fc and X axis means the specificity to human CD137 or CD3 of each clone.

FIG. 14 A graph showing the result of competitive ELISA of IgGs obtained with phage display to CD3 and CD137.

Y axis means the response of ELISA to biotin-human CD137-Fc or biotin-human Fc. Excess amount of human CD3 were used as competitor.

FIG. 15 A graph showing the result of ELISA of IgGs obtained with phage display to CD3 and CD137 to identify the epitope domain of each clones.

Y axis means the response of ELISA to each domain of human CD137.

FIG. 16 A set of graphs showing the result of ELISA of IgGs obtained with phage display affinity maturation to CD3 and CD137.

Y axis means the specificity to human CD137-Fc and X axis means the specificity to human CD137 or CD3 of each clone.

FIG. 17.1 A set of graphs showing the result of competitive ELISA of IgGs obtained with phage display to CD3 and CD137.

Y axis means the response of ELISA to biotin-human CD137-Fc or biotin-human Fc. An excess amount of human CD3 was used as a competitor.

FIG. 17.2 A set of graphs showing the result of competitive ELISA of IgGs obtained with phage display to CD3 and CD137.

Y axis means the response of ELISA to biotin-human CD137-Fc or biotin-human Fc. An excess amount of human CD3 was used as a competitor.

FIG. 17.3 A set of graphs showing the result of competitive ELISA of IgGs obtained with phage display to CD3 and CD137.

Y axis means the response of ELISA to biotin-human CD137-Fc or biotin-human Fc. An excess amount of human CD3 was used as a competitor.

FIG. 17.4 A set of graphs showing the result of competitive ELISA of IgGs obtained with phage display to CD3 and CD137.

Y axis means the response of ELISA to biotin-human CD137-Fc or biotin-human Fc. An excess amount of human CD3 was used as a competitor.

FIG. 17.5 A set of graphs showing the result of competitive ELISA of IgGs obtained with phage display to CD3 and CD137.

Y axis means the response of ELISA to biotin-human CD137-Fc or biotin-human Fc. An excess amount of human CD3 was used as a competitor.

FIG. 18A A drawing schematically showing the mechanism of IL-6 secretion from the activated B cell via anti-human GPC3/Dual-Fab antibodies.

FIG. 18B A graph showing the results of assessing the CD137-mediated agonist activity of various anti-human GPC3/Dual-Fab antibodies by the level of production of IL-6 which is secreted from the activated B cells.

Ctrl indicates the negative control human IgG1 antibody.

FIG. 19A A drawing schematically showing the mechanism of Luciferase expression in the activated Jurkat T cell via anti-human GPC3/Dual-Fab antibodies.

FIG. 19B A set of graphs showing the results of assessing the CD3 mediated agonist activity of various anti-human GPC3/Dual-Fab antibodies by the level of production of Luciferase which is expressed in the activated Jurkat T cells.

Ctrl indicates the negative control human IgG1 antibody.

FIG. 20 A set of graphs showing the results of assessing the cytokine (IL-2, IFN-gamma and TNF-alpha) release from human PBMC derived T cells in the presence of each immobilized antibodies.

Y axis means the concentration of secreted each cytokines and X-axis means the concentration of immobilized antibodies. Control anti-CD137 antibody (B), control anti-CD3 antibody (CE115), negative control antibody (Ctrl) and one of the dual antibody (L183L072) were used for assay.

FIG. 21 A set of graphs showing the results of assessing the T-cell dependent cellular cytotoxicity (TDCC) against GPC3 positive target cells (SK-pca60 and SK-pca13a) with each bi-specific antibodies.

Y axis means the ratio of Cell Growth Inhibition (CGI) and X-axis means the concentration of each bi-specific antibodies. Anti-GPC3/Dual Bi-specific antibody (GC33/H183L072), Negative control/Dual Bi-specific antibody (Ctrl/H183L072), Anti-GPC3/Anti-CD137 Bi-specific antibody (GC33/B) and Negative control/Anti-CD137 Bi-specific antibody (Ctrl/B) were used for this assay. 5-fold amount of effector (E) cells were added on tumor (T) cells (ET5).

FIG. 22 A graph showing results of cell-ELISA of CE115 for CD3e.

FIG. 23 A diagram showing the molecular form of EGFR_ERY22_CE115.

FIG. 24 A graph showing results of TDCC (SK-pca13a) of EGFR_ERY22_CE115.

FIG. 25 An exemplary sensorgram of an antibody having a ratio of the amounts bound of less than 0.8.

The vertical axis depicts an RU value (response). The horizontal axis depicts time.

FIG. 26 A drawing depicting examples of modified antibodies in which the Fabs are crosslinked with each other.

The figure schematically shows structural differences between a wild-type antibody (WT) and a modified antibody in which the CH1 regions of antibody H chain are crosslinked with each other (HH type), a modified antibody in which the CL regions of antibody L chain are crosslinked with each other (LL type), and a modified antibody in which the CH1 region of antibody H chain is crosslinked with the CL region of antibody L chain (HL or LH type).

FIG. 27 A drawing showing the results of protease treatment of an anti-IL6R antibody (MRA), modified antibodies produced by introducing a cysteine substitution into the heavy chain variable region of the anti-IL6R antibody (MRAH xxx-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 28 A drawing showing the results of protease treatment of an anti-IL6R antibody (MRA), modified antibodies produced by introducing a cysteine substitution into the heavy chain variable region of the anti-IL6R antibody (MRAH.xxx-G1T4), and modified antibodies produced by introducing a cysteine substitution in the heavy chain constant region of the anti-IL6R antibody (MRAH-G1T4.xxx), as described in Reference Example 15

Each protease-treated antibody was applied to non-reducing capillary electrophoresis, followed by band detection with an anti-kappa chain antibody.

FIG. 29 A drawing showing the results of protease treatment of an anti-IL6R antibody (MRA), modified antibodies produced by introducing a cysteine substitution into the heavy chain variable region of the anti-IL6R antibody (MRAH.xxx-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 30 A drawing showing the results of protease treatment of an anti-IL6R antibody (MRA), modified antibodies produced by introducing a cysteine substitution into the heavy chain variable region of the anti-IL6R antibody (MRAH.xxx-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 31 A drawing showing the results of protease treatment of an anti-IL6R antibody (MRA), modified antibodies produced by introducing a cysteine substitution into the heavy chain variable region of the anti-IL6R antibody (MRAH.xxx-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 32 A drawing showing the results of protease treatment of an anti-IL6R antibody (MRA), modified antibodies produced by introducing a cysteine substitution into the heavy chain variable region of the anti-IL6R antibody (MRAH.xxx-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 33 A drawing showing the results of protease treatment of an anti-IL6R antibody (MRA), modified antibodies produced by introducing a cysteine substitution into the heavy chain variable region of the anti-IL6R antibody (MRAH.XXX-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 34 A drawing showing the results of protease treatment of an anti-IL6R antibody (MRA), modified antibodies produced by introducing a cysteine substitution into the heavy chain variable region of the anti-IL6R antibody (MRAH.xxx-G1T4), and modified antibodies produced by introducing a cysteine substitution in the heavy chain constant region of the anti-IL6R antibody (MRAH-G1T4.xxx), as described in Reference Example 15.

Each protease-treated antibody was applied to non-reducing capillary electrophoresis, followed by band detection with an anti-kappa chain antibody.

FIG. 35 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 36 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 37 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 38 A drawing showing the results of protease treatment of an anti-IL6R antibody (MRA), modified antibodies produced by introducing a cysteine substitution into the light chain variable region of the anti-IL.6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 39 A drawing showing the results of protease treatment of an anti-IL6R antibody (MRA), modified antibodies produced by introducing a cysteine substitution into the light chain variable region of the anti-IL.6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 40 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 41 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 42 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 43 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 44 A drawing showing the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution in the light chain constant region of the anti-IL6R antibody (MRAL-k0.xxx), as described in Reference Example 16.

Each protease-treated antibody was applied to non-reducing capillary electrophoresis, followed by band detection with an anti-kappa chain antibody.

FIG. 45 A drawing showing the results of protease treatment of an anti-IL6R antibody (MRA) and a modified antibody produced by introducing a cysteine substitution in the light chain constant region of the anti-IL6R antibody (MRAL-k0.K126C), as described in Reference Example 17.

Each protease-treated antibody was applied to non-reducing capillary electrophoresis, followed by band detection with an anti-kappa chain antibody or an anti-human Fc antibody.

FIG. 46 A drawing showing the correspondence between the molecular weight of each band obtained by protease treatment of the antibody sample and its putative structure, as described in Reference Example 17.

It is also noted the structure of each molecule whether the molecule may react with an anti-kappa chain antibody or an anti-Fc antibody (whether a band is detected in the electrophoresis of FIG. 45).

DESCRIPTION OF EMBODIMENTS

In the present invention, the "antigen binding domain" means a domain which comprises at least a portion of a heavy chain variable (VH) region and/or a portion of a light chain variable (VL) region of an antibody, each of which comprises four framework regions (FRs) and three complementarity-determining regions (CDRs) flanked thereby, as long as it has the activity of binding to a portion or the whole of an antigen. Particularly, in the present invention, the "antigen-binding domain" comprising a light chain variable (VL) region or a heavy chain variable (VH) region is preferred. More particularly, in the present invention, the "antigen-binding domain" comprising a light chain variable (VL) region and a heavy chain variable (VH) region is preferred.

In the present invention, the "antigen-binding domain" in the present invention also means a domain which comprises;

(i) a heavy chain variable (VH) region and a CH1 region of an antibody heavy chain constant region;
(ii) a heavy chain variable (VH) region, a CH1 region of an antibody heavy chain constant region and a hinge region of an antibody heavy chain;
(iii) a light chain variable (VL) region and a light chain constant (CL) region,
(iv) a heavy chain variable (VH) region and a CH1 region of an antibody heavy chain constant region, and a light chain variable (VL) region;
(v) a heavy chain variable (VH) region and a CH1 region of an antibody heavy chain constant region, and a light chain variable (VL) region and a light chain constant (CL) region;
(vi) a heavy chain variable (VH) region, a CH1 region of an antibody heavy chain constant region and a hinge region of an antibody heavy chain, and a light chain variable (VL) region;
(vii) a heavy chain variable (VH) region, a CH1 region of an antibody heavy chain constant region and a hinge region of an antibody heavy chain, and a light chain variable (VL) region and a light chain constant (CL) region; or
(viii) a heavy chain variable (VH) region, and a light chain variable (VL) region and a light chain constant (CL) region;

The antigen-binding domain of the present invention may have an arbitrary sequence and may be an antigen-binding domain derived from any antibody such as a mouse antibody, a rat antibody, a rabbit antibody, a goat antibody, a camel antibody, and a humanized antibody obtained by the humanization of any of these nonhuman antibodies, and a human antibody. The "humanized antibody", also called reshaped human antibody, is obtained by grafting complementarity determining regions (CDRs) of a non-human mammal-derived antibody, for example, a mouse antibody to human antibody CDRs. Methods for identifying CDRs are known in the art (Kabat et al., Sequence of Proteins of Immunological Interest (1987), National Institute of Health, Bethesda, Md.; and Chothia et al., Nature (1989) 342: 877). General gene recombination approaches therefor are also known in the art (see European Patent Application Publication No. EP 125023 and WO 96/02576).

In the present invention, the "antigen-binding molecule" is not particularly limited as long as the molecule comprises the "antigen-binding domain" of the present invention. The antigen-binding molecule may further comprise a peptide or a protein having a length of approximately 5 or more amino acids. The peptide or the protein is not limited to a peptide or a protein derived from an organism, and may be, for example, a polypeptide consisting of an artificially designed sequence. Also, a natural polypeptide, a synthetic polypeptide, a recombinant polypeptide, or the like may be used.

In some embodiments, the antigen-binding molecule of the present invention are an antigen-binding molecule comprising an antibody Fc region. "Fc region" in the present invention is as defined below.

In some embodiments, the "antigen-binding molecule" of the present invention may be an antigen-binding molecule comprising the antigen-binding domain as defined above, which comprises a heavy chain variable (VH) region and a light chain variable (VL) region in a single polypeptide chain linked by one or more linkers, but lacks a Fc region, like a diabody (Db), a single-chain antibody, or sc(Fab')2.

If the term "antibody fragment" is used in the instant application, it may mean a molecule other than an intact antibody that comprises a portion of an intact antibody that binds the antigen to which the intact antibody binds. Examples of antibody fragments include but are not limited to Fv, Fab, Fab'. Fab'-SH, F(ab')2; diabodies; linear antibodies; single-chain antibody molecules (e.g. scFv); single chain Fabs (scFabs); single domain antibodies; and multispecific antibodies formed from antibody fragments.

If the term "variable fragment (Fv)" is used in the instant application, it may refers to the minimum unit of an antibody-derived portion binding to an antigen that is composed of a pair of the antibody light chain variable region (VL) and antibody heavy chain variable region (VH) In 1988, Skerra and Pluckthun found that homogeneous and active antibodies can be prepared from the *E. coli* periplasm fraction by inserting an antibody gene downstream of a bacterial signal sequence and inducing expression of the gene in *E. coli* (Science (1988) 240 (4855), 1038-1041). In the Fv prepared from the periplasm fraction. VH associates with VL in a manner so as to bind to an antigen.

If the terms "scFv". "single-chain antibody", and "sc (Fv) 2" are used in the instant application, those refer to an antibody fragment of a single polypeptide chain that contains variable regions derived from the heavy and light chains, but not the constant region. In general, a single-chain antibody also contains a polypeptide linker between the VH and VL domains, which enables formation of a desired structure that is thought to allow antigen binding. The single-chain antibody is discussed in detail by Pluckthun in "The Pharmacology of Monoclonal Antibodies, Vol. 113. Rosenburg and Moore, eds. Springer-Verlag, New York, 269-315 (1994)". See also International Patent Publication WO 1988/001649; U.S. Pat. Nos. 4,946,778 and 5,260,203. In a particular embodiment, the single-chain antibody can be bispecific and/or humanized.

If the term "scFv" is used in the instant application, it may mean a single chain polypeptide in which VH and VL forming Fv are linked together by a peptide linker (Proc. Natl. Acad. Sci. U.S.A. (1988) 85 (16), 5879-5883). VH and VL can be retained in close proximity by the peptide linker.

If the term "sc(Fv)2" is used in the instant application, it may mean a single-chain antibody in which four variable regions of two VL and two VH are linked by linkers such as peptide linkers to form a single chain (J Immunol. Methods (1999) 231 (1-2), 177-189). The two VH and two VL may be derived from different monoclonal antibodies. Such sc(Fv)2 preferably includes, for example, a bispecific sc(Fv)2 that recognizes two epitopes present in a single antigen as disclosed in the Journal of Immunology (1994) 152 (11), 5368-5374, sc(Fv)2 can be produced by methods known to those skilled in the art. For example, sc(Fv)2 can be produced by linking scFy by a linker such as a peptide linker.

Herein, the sc (Fv) 2 takes a form in which the two VH units and two VL units of an antibody are arranged in the order of VH, VL, VH, and VL ([VH]-linker-[VL]-linker-[VH]-linker-[VL]) beginning from the N terminus of a single-chain polypeptide. The order of the two VH units and two VL units is not limited to the above form, and they may be arranged in any order. Example order of the form is listed below.

[VL]-linker-[VH]-linker-[VH]-linker-[VL]
[VH]-linker-[VL]-linker-[VL]-linker-[VH]
[VH]-linker-[VH]-linker-[VL]-linker-[VL]
[VL]-linker-[VL]-linker-[VH]-linker-[VH]
[VL]-linker-[VH]-linker-[VL]-linker-[VH]

If the term "Fab", "F(ab')2", and "Fab" are used in the instant application, those may mean as below.

"Fab" consists of a single light chain, and a CH1 region and variable region from a single heavy chain. The heavy chain of a wild-type Fab molecule cannot form disulfide bonds with another heavy chain molecule. Depending on any purpose, Fab variants in which amino acid residue(s) in a wild-type Fab molecule may be altered by substitution, addition, or deletion are also included. In a specific embodiment, mutated amino acid residue(s) comprised in Fab variants (e.g., cysteine residue(s) or lysine residue(s) after substitution, addition, or insertion) can form disulfide bond(s) with another heavy chain molecule or a portion thereof (e.g., Fab molecule).

scFab is an antigen-binding domain in which a single light chain, and a CH1 region and variable region from a single heavy chain which form Fab are linked together by a peptide linker. The light chain, and the CH1 region and variable region from the heavy chain can be retained in close proximity by the peptide linker.

"F(ab')2" or "Fab" is produced by treating an immunoglobulin (monoclonal antibody) with a protease such as pepsin and papain, and refers to an antibody fragment generated by digesting an immunoglobulin (monoclonal antibody) at near the disulfide bonds present between the hinge regions in each of the two H chains. For example, papain cleaves IgG upstream of the disulfide bonds present between the hinge regions in each of the two H chains to generate two homologous antibody fragments, in which an L chain comprising VL (L-chain variable region) and CL (L-chain constant region) is linked to an H-chain fragment comprising VH (H-chain variable region) and CH gamma 1 (gamma 1 region in an H-chain constant region) via a disulfide bond at their C-terminal regions. Each of these two homologous antibody fragments is called Fab'.

"F(ab')2" consists of two light chains and two heavy chains comprising the constant region of a CH1 domain and a portion of CH2 domains so that disulfide bonds are formed between the two heavy chains. For example, the F(ab')2 disclosed herein can be produced as follows. A whole monoclonal antibody or such comprising a desired antigen-binding domain is partially digested with a protease such as pepsin, and Fc fragments are removed by adsorption onto a Protein A column. The protease is not particularly limited, as long as it can cleave the whole antibody in a selective manner to produce F(ab')2 under an appropriate setup enzyme reaction condition such as pH. Such proteases include, for example, pepsin and ficin.

If the term "single domain antibodies" is used in the instant application, those are not particularly limited in their structure, as long as the domain can exert antigen-binding activity by itself. Ordinary antibodies exemplified by IgG antibodies exert antigen-binding activity in a state where a variable region is formed by the pairing of VH and VL. In contrast, a single domain antibody is known to be able to exert antigen-binding activity by its own domain structure alone without pairing with another domain. Single domain antibodies usually have a relatively low molecular weight and exist in the form of a monomer.

Examples of a single domain antibody include, but are not limited to, antigen binding molecules which naturally lack light chains, such as VHH of Camelidae animals and VNAR of sharks, and antibody fragments comprising the whole or a portion of an antibody VH domain or the whole or a portion of an antibody VL domain. Examples of a single domain antibody which is an antibody fragment comprising the whole or a portion of an antibody VH/VL domain include, but are not limited to, artificially prepared single domain antibodies originating from a human antibody VH or a human antibody VL as described, e.g., in U.S. Pat. No. 6,248,516 B1. In some embodiments of the present invention, one single domain antibody has three CDRs (CDR1, CDR2, and CDR3).

Single domain antibodies can be obtained from animals capable of producing single domain antibodies or by immunizing animals capable of producing single domain antibodies. Examples of animals capable of producing single domain antibodies include, but are not limited to, camelids and transgenic animals into which gene(s) for the capability of producing a single domain antibody has been introduced. Camelids include camel, llama, alpaca, dromedary, guanaco, and such. Examples of a transgenic animal into which gene(s) for the capability of producing a single domain antibody has been introduced include, but are not limited to, the transgenic animals described in International Publication No. WO2015/143414 or US Patent Publication No. US2011/0123527 A1. Humanized single chain antibodies can also be obtained, by replacing framework sequences of a single domain antibody obtained from an animal with human germline sequences or sequences similar thereto. A humanized single domain antibody (e.g., humanized VHH) is one embodiment of the single domain antibody of the present invention.

Alternatively, single domain antibodies can be obtained from polypeptide libraries containing single domain antibodies by ELISA, panning, and such. Examples of polypeptide libraries containing single domain antibodies include, but are not limited to, naive antibody libraries obtained from various animals or humans (e.g., Methods in Molecular Biology 2012 911 (65-78) and Biochimica et Biophysica Acta-Proteins and Proteomics 2006 1764:8 (1307-1319)), antibody libraries obtained by immunizing various animals (e.g., Journal of Applied Microbiology 2014 117:2 (528-536)), and synthetic antibody libraries prepared from antibody genes of various animals or humans (e.g., Journal of Biomolecular Screening 2016 21:1 (35-43), Journal of Biological Chemistry 2016 291:24 (12641-12657), and AIDS 2016 30:11 (1691-1701)).

If the term "Db" is used in the instant application, it may mean a dimer constituted by two polypeptide chains (e.g., Holliger P et al., Proc. Natl. Acad. Sci. USA 90:6444-6448 (1993); EP404,097; and WO93/11161). These polypeptide chains are linked through a linker as short as, for example, approximately 5 residues, such that an L chain variable domain (VL) and an H chain variable domain (VH) on the same polypeptide chain cannot be paired with each other.

Because of this short linker, VL and VH encoded on the same polypeptide chain cannot form single-chain Fy and instead, are dimerized with VH and VL, respectively, on another polypeptide chain, to form two antigen-binding sites.

In the present invention, the "Fc region" refers to a region comprising a fragment consisting of a hinge or a portion thereof and CH2 and CH3 domains in an antibody molecule. The Fc region of IgG class means, but is not limited to, a region from, for example, cysteine 226 (EU numbering (also referred to as EU index herein)) to the C terminus or proline 230 (EU numbering) to the C terminus. The Fc region can be preferably obtained by the partial digestion of, for example, an IgG1, IgG2, IgG3, or IgG4 monoclonal antibody with a proteolytic enzyme such as pepsin followed by the re-elution of a fraction adsorbed on a protein A column or a protein G column. Such a proteolytic enzyme is not particularly limited as long as the enzyme is capable of digesting a whole antibody to restrictively form Fab or F(ab')2 under appropriately set reaction conditions (e.g., pH) of the enzyme. Examples thereof can include pepsin and papain.

The "antigen-binding domain" of the present invention that "capable of binding to a first antigen and a second antigen which is different from the first antigen, but does not bind to the first antigen and the second antigen at the same time" means that the antigen-binding domain of the present invention cannot bind to the second antigen in a state bound with the first antigen whereas the variable region cannot bind to the first antigen in a state bound with the second antigen. In this context, the phrase "does not bind to the first antigen and the second antigen at the same time" also includes the meaning that the "antigen-binding domain", by the single antigen-binding domain itself, does not cross-link a cell (e.g., effector cell such as T cell, NK cell, DC cell or the like) expressing the first antigen to a cell (e.g., effector cell such as T cell. NK cell. DC cell or the like) expressing the second antigen, or not bind to the first antigen and the second antigen each expressed on different cells, at the same time. This phrase further includes the case where the antigen-binding domain is capable of binding to both the first antigen and the second antigen at the same time when the first antigen and the second antigen are not expressed on cell membranes, as with soluble proteins, or both reside on the same cell, but cannot bind to the first antigen and the second antigen each expressed on different cells, at the same time. Such an antigen-binding domain is not particularly limited as long as the antigen-binding domain has these functions. Examples thereof can include antigen-binding domain derived from an IgG-type antibody by the alteration of a portion of its amino acids so as to bind to the desired antigen. The amino acid to be altered is selected from, for example, amino acids whose alteration does not cancel the binding to the antigen, in an antigen-binding domain binding to the first antigen or the second antigen.

In this context, the phrase "expressed on different cells" merely means that the antigens are expressed on separate cells. The combination of such cells may be, for example, the same types of cells such as a T cell and another T cell, or may be different types of cells such as a T cell and an NK cell.

In the instant application, the above-defined "antigen-binding domain" of the present invention that is "capable of binding to a first antigen and a second antigen which is different from the first antigen" may be described with the abbreviated term "Dual" or "dual". In some embodiments, in the case that both of a first antigen-binding domain and a second binding domains of an antigen-binding molecule of the present invention are the "Dual", it may be indicated as "Dual/Dual" or "dual/dual". In some embodiments, in the case that either of a first antigen-binding domain and a second binding domains of an antigen-binding molecule of the present invention is the "Dual" and the other antigen-binding domain only binds to a single antigen (i.e., binds to only either one of a first antigen or a second antigen), for example, CD3 or CD137, it may be indicated as "Dual/CD3. "CD3/Dual", "Dual/CD137", "CD137/Dual" or the like.

In further some embodiments, in the case that, among the above-embodiments, either of a first antigen-binding domain or a second binding domains of an antigen-binding molecule of the present invention is linked to a third antigen binding domain which is capable of binding to a third antigen (as defined below; e.g., GPC3) which is different from the first antigen and the second antigen, it may be indicated as, e.g., "GPC3-Dual/Dual", "GPC3-Dual/CD3, "GPC3-CD3/Dual", "GPC3-Dual/CD137", "GPC3-CD137/Dual" or the like.

In further some embodiments, in the case that, among the above-embodiments, in the case that "the first antigen-binding domain and the second antigen-binding domain are linked with each other via at least one bond which holds the first antigen-binding domain and the second antigen-binding domain close to each other" (as defined below), it may be indicated as, e.g., "Dual/CD3 (line), "CD3/Dual (line)", "Dual/CD137 (line)", "CD137/Dual (line)" "GPC3-Dual/Dual (line)", "GPC3-Dual/CD3 (line), "GPC3-CD3/Dual (line)", "GPC3-Dual/CD137 (line)". "GPC3-CD137/Dual (line)" or the like.

In the present invention, the term "capable of binding to only either one of the first antigen or the second antigen" means that (i) the antigen-binding domain of the present invention has a binding activity to only either one of the first antigen or the second antigen which is different from the first antigen, and does not have a binding activity to the other antigen out of the first or second antigen; (ii) the antigen-binding domain of the present invention has a binding activity predominantly to either one of the first antigen or the second antigen which is different from the first antigen; (iii) the antigen-binding domain of the present invention has a significant binding activity (e.g. KD is less than $1\times10^{-5}$ M, less than $1\times10^{-7}$M, less than $1\times10^{-8}$ M or less than $1\times10^{-9}$ M) to either one of the first antigen or the second antigen which is different from the first antigen, whereas, to the other antigen out of the first or second antigen, it has weak binding activity (e.g., KD is higher than $1\times10^{-3}$ M, higher than $1\times10^{-4}$ M or higher than $1\times10^{-5}$ M); (iv) the antigen-binding domain of the present invention has a binding activity to either one of the first antigen or the second antigen which is different from the first antigen, whereas, to the other antigen out of the first or second antigen, it has non-detectable binding activity as determined using a method known in the art, for example an electrochemiluminescence method (ECL) or surface plasmon resonance (SPR) method; (v) the antigen-binding domain of the present invention has a 1-fold, 5-fold, 10-fold, 50-fold, 100-fold, 1000-fold, 10000-fold, 100000-fold or more higher binding activity to the first antigen (the second antigen) compared to binding to the second antigen which is different from the first antigen (the first antigen).

In some embodiments, binding activity or affinity of the antigen-binding domains of the present invention to the first or second antigen (e.g. CD3, CD137) are assessed at 25 degrees C., or 37 degrees C. using e.g., Biacore T200 instrument (GE Healthcare). Anti-human Fc (e.g., GE Healthcare) is immobilized onto all flow cells of a CM4 sensor chip using amine coupling kit (e.g. GE Healthcare). The antigen-binding domains are captured onto the anti-Fc sensor surfaces, then the antigen (e.g. recombinant human CD3 or CD137) is injected over the flow cell. All antigen-binding domains and analytes are prepared in ACES pH 7.4 containing 20 mM ACES, 150 mM NaCl, 0.05% Tween 20, 0.005% NaN3. Sensor surface is regenerated each cycle with 3M MgCl2. Binding affinity are determined by processing and fitting the data to 1:1 binding model using e.g., Biacore T200 Evaluation software, version 2.0 (GE Healthcare). In some embodiments, CD3 binding affinity assay is conducted in the above-mentioned condition with assay temperature is set at 25 degrees C., and CD137 binding affinity assay was conducted in same condition except assay temperature is set at 37 degrees C.

In some embodiments of the present invention. "the first antigen-binding domain and the second antigen-binding domain are linked with each other via at least one bond". The at least one bond to link the first antigen-binding domain and the second antigen-binding domain can be introduced into any one or more of the followings;

(i) between a CH1 region of an antibody heavy chain constant of the first antigen-binding domain and a CH1 region of an antibody heavy chain constant of the second antigen-binding domain;

(ii) between a hinge region of an antibody heavy chain of the first antigen-binding domain and a hinge region of an antibody heavy chain of the second antigen-binding domain;

(iii) between a light chain constant (CL) region of the first antigen-binding domain and a light chain constant (CL) region of the second antigen-binding domain, (iv) between a CH1 region of an antibody heavy chain constant of the first antigen-binding domain and a light chain constant (CL) region of the second antigen-binding domain;

(v) between a light chain constant (CL) region of the first antigen-binding domain and a CH1 region of an antibody heavy chain constant of the second antigen-binding domain; and/or (vi) between a heavy chain variable (VH) region of the first antigen-binding domain and a heavy chain variable (VH) region of the second antigen-binding domain.

Here, in the case of the above (ii), the "at least one bond" introduced between the two hinge regions is one or more additional bonds other than one or more native disulfide bonds between cysteine residues which wild-type antibodies usually possess between the hinge regions of the respective heavy chains. For example. IgG1 antibody has two native disulfide bonds between the hinge regions of the respective heavy chains, and IgG2 and IgG3 have more disulfide bonds between the hinge regions of the respective heavy chains. Examples of such cysteine residues include the cysteine residues at positions 226 and 229 according to EU numbering. In the present invention, the "at least one bond" introduced between the hinge regions of the above case (ii) is one or more additional bonds except for such originally-existing disulfide bonds in the hinge regions of IgG1, IgG2, IgG3 or the like.

In the present invention, in any of the above case (i) to (vi), the "at least one bond" can be introduced into any amino acid position of each of the two CH1 region, any amino acid position of each of the two hinge region; any amino acid position of each of the two CL region, to the extent that the antigen-binding molecule of the present invention exerts, accomplish and/or maintain a desired properties.

In an embodiment of the above aspects, in at least one of the first and second antigen-binding domains, one or more (e.g., multiple) amino acid residues from which the bonds between the antigen-binding domains originate are present at positions at a distance of seven amino acids or more from each other in the primary structure. This means that, between any two amino acid residues of the above multiple amino acid residues, six or more amino acid residues which are not said amino acid residues are present. In certain embodiments, combinations of multiple amino acid residues from which the bonds between the antigen-binding domains originate include a pair of amino acid residues which are present at positions at a distance of less than seven amino acids in the primary structure. In certain embodiments, if the first and second antigen-binding domains are linked each other via three or more bonds, the bonds between the antigen-binding domains may originate from three or more amino acid residues including a pair of amino acid residues which are present at positions at a distance of seven amino acids or more in the primary structure.

In certain embodiments, amino acid residues present at the same position in the first antigen-binding domain and in the second antigen-binding domain are linked with each other to form a bond. In certain embodiments, amino acid residues present at a different position in the first antigen-binding domain and in the second antigen-binding domain are linked with each other to form a bond.

Positions of amino acid residues in the antigen-binding domain can be shown according to the Kabat numbering or EU numbering system (also called the EU index) described in Kabat et al., Sequences of Proteins of Immunological Interest, 5th Ed. Public Health Service. National Institutes of Health, Bethesda. MD, 1991. For example, if the amino acid residues from which the bonds between the first and second antigen-binding domains originate are present at an identical position corresponding in the antigen-binding domains, the position of these amino acid residues can be indicated as the same number according to the Kabat numbering or EU numbering system. Alternatively, if the amino acid residues from which the bonds between the first and second antigen-binding domains originate are present at different positions which are not corresponding in the antigen-binding domains, the positions of these amino acid residues can be indicated as different numbers according to the Kabat numbering or EU numbering system.

As described above, in an embodiment of the above aspects, at least one of amino acid residues from which the bonds between the antigen-binding domains originate is present within a constant region. In certain embodiments, the amino acid residue is present within a CH1 region of an antibody heavy chain constant region, and for example, it is present at a position selected from the group consisting of positions 119, 122, 123, 131, 132, 133, 134, 135, 136, 137, 139, 140, 148, 150, 155, 156, 157, 159, 160, 161, 162, 163, 165, 167, 174, 176, 177, 178, 190, 191, 192, 194, 195, 197, 213, and 214 according to EU numbering in the CH1 region. In an exemplary embodiment, the amino acid residue is present at position 191 according to EU numbering in the CH1 region, and the amino acid residues at position 191 according to EU numbering in the CH1 region of the two antigen-binding domains are linked with each other to form a bond.

In certain embodiments, at least one of amino acid residues from which the bonds between the antigen-binding domains originate is present within a hinge region, and for example, it is present at a position selected from the group consisting of positions 216, 218, and 219 according to EU numbering in the hinge region.

In certain embodiments, at least one of amino acid residues from which the bonds between the antigen-binding domains originate is present within an light chain constant (CL) region, and for example, it is present at a position selected from the group consisting of positions 109, 112, 121, 126, 128, 151, 152, 153, 156, 184, 186, 188, 190, 200, 201, 202, 203, 208, 210, 211, 212, and 213 according to EU numbering in the CL region. In an exemplary embodiment, the amino acid residue is present at position 126 according to EU numbering in the CL region, and the amino acid residues at position 126 according to EU numbering in the CL region of the two antigen-binding domains are linked with each other to form a bond.

As described above, in certain embodiments, an amino acid residue in the CH1 region of the first antigen-binding domain and an amino acid residue in the CL region of the second antigen-binding domain are linked to form a bond. In an exemplary embodiment, an amino acid residue at position 191 according to EU numbering in the CH1 region of the first antigen-binding domain and an amino acid residue at position 126 according to EU numbering in the CL region of the second antigen-binding domain are linked to form a bond.

As described above, in an embodiment of the above aspects, at least one of amino acid residues from which the bonds between the antigen-binding domains originate is present within a heavy chain (VH) variable region and/or a light chain variable (VL) region. In certain embodiments, the amino acid residue is present within a VH region, and for example, it is present at a position selected from the group consisting of positions 8, 16, 28, 74, and 82b according to Kabat numbering in the VH region. In certain embodiments, the amino acid residue is present within a VL region, and for example, it is present at a position selected from the group consisting of positions 100, 105, and 107 according to Kabat numbering in the VL region.

In the present invention, the "at least one bond" be introduced to link the first antigen-binding domain and the second antigen-binding domain as described above can be any type of bond, which is selected from but not limited to:

(i) a covalent bond (e.g., a covalent bond formed by direct crosslinking between an amino acids such as a disulfide bond between cysteine residues; a covalent bond formed by crosslinking between an amino acids via cross-linking agent such as a covalent bond between lysine residues via amine-reactive cross-linking agent, or the like); and/or (ii) a noncovalent bond (e.g., ionic bond, hydrogen bond, hydrophobic bond, or the like).

In the present invention, the "at least one bond" be introduced to link the first antigen-binding domain and the second antigen-binding domain as described above can hold the first antigen-binding domain and the second antigen-binding domain close to each other. Here, the term "hold the first antigen-binding domain and the second antigen-binding domain close to each other" is explained as, but not limited to, below.

In an embodiment of the above aspects, "at least one bond" be introduced to link the first antigen-binding domain and the second antigen-binding domain as described above can hold the two antigen binding domains (i.e., the first antigen-binding domain and the second antigen-binding domain as described above) spatially close positions. By virtue of the linkage between the first antigen-binding domains and the second antigen-binding domain via the bond(s), the antigen-binding molecule of the present invention is capable of holding two antigen-binding domains at closer positions than a control antigen-binding molecule, which differs from the antigen-binding molecule of the present invention only in that the control antigen-binding molecule does not have the additional bond(s) introduced between the two antigen-binding domains. In some embodiments, the term "spatially close positions" or "closer positions" includes the meaning that the first antigen-binding domain and the second antigen-binding domain as described above hold in shortened distance and/or reduced flexibility.

As the results, the two antigen binding domains (i.e., the first antigen-binding domain and the second antigen-binding domain as described above) of the antigen-binding molecule of the present invention binds to the antigens expressed on the same single cell. In other words, the respective two antigen-binding domains (i.e., the first antigen-binding domain and the second antigen-binding domain as described above) of the antigen-binding molecule of the present invention do not bind to antigens expressed on different cells so as to cause a cross-linking the different cells. In the present application, such antigen-binding manner of the antigen-binding molecule of the present invention can be called as "cis-binding", whereas the antigen-binding manner of an antigen-binding molecule which respective two antigen-binding domains of the antigen-binding molecule bind to antigens expressed on different cells so as to cause a cross-linking the different cells can be called as "trans-binding". In some embodiments, the antigen-binding molecule of the present invention predominantly binds to the antigens expressed on the same single cell in "cis-biding" manner.

In an embodiment of the above aspects, by virtue of the linkage between the first antigen-binding domains and the second antigen-binding domain via the bond(s) as described above, the antigen-binding molecule of the present invention is capable of reducing and/or preventing unwanted cross-linking and activation of immune cells (e.g., T-cells. NK cells. DC cells, or the like). That is, in some embodiments of the present invention, the first antigen-binding domain of the antigen-binding molecule of the present invention binds to any signaling molecule expressed on an immune cell such as T-cell (e.g., the first antigen), and the second antigen-binding domain of the antigen-binding molecule of the present invention also binds to any signaling molecule expressed on an immune cell such as T-cell (e.g., the first antigen or the second antigen which is different from the first antigen). Thus, the first antigen-binding domain and the second antigen-binding domain of the antigen binding-molecule of the present invention can bind to either of the first or second signaling molecule expressed on the same single immune cell such as T cell (i.e., cis-binding manner) or on different immune cell such as T cells (i.e., trans-biding manner). When the first antigen-binding domain and the second antigen-binding domain bind to the signaling molecule expressed on different immune cells such as T-cells in trans-binging manner, those different immune cells such as T-cells are cross-linked, and, in certain situation, such cross-linking of immune cells such as T-cells may cause unwanted activation of the immune cells such as T-cells.

On the other hand, in the case of another embodiment of the antigen-binding molecule of the present invention, that is, an antigen-binding molecule comprising the first antigen-binding domain and the second antigen-binding domain, which are linked with each other via at least one bond holding the two antigen-binding domains close to each other, both of the first antigen-binding domain and the second antigen-binding domain can binds to the signaling molecules expressed on the same single immune cells such as T cell in "cis-biding" manner, so that the crosslinking of different immune cells such as T-cells via the antigen-binding molecule can be reduced to avoid unwanted activation of immune cells.

In the instant application, the above-described feature, that is, the first antigen-binding domain and the second antigen-binding domain are linked with each other via at least one bond which holds the first antigen-binding domain and the second antigen-binding domain close to each other" may be described with the abbreviated term "line". Using this abbreviation, in some embodiments, the above-described antigen-binding molecule of the present invention may be indicated as, e.g., "Dual/CD3 (line), "CD3/Dual (line)". "Dual/CD137 (line)". "CD137/Dual (line)" "GPC3-Dual/Dual (line)". "GPC3-Dual/CD3 (line), "GPC3-CD3/Dual (line)". "GPC3-Dual/CD137 (line)", "GPC3-CD137/Dual (line)" or the like.

In some embodiments, the antigen-binding molecule of the present invention can comprise one or more amino acid alteration(s) in any one or more portion(s) of the antigen binding domain, a heavy chain variable (VH) region, a light chain variable (VL) region, a CH1 of a heavy chain constant region, a light chain constant (CL) region, a hinge region of an antibody heavy chain, and a Fc region (as described below). One amino acid alteration may be used alone, or a plurality of amino acid alterations may be used in combination. In the case of using a plurality of amino acid alterations in combination, the number of the alterations to be combined is not particularly limited and can be appropriately set within a range that can attain the object of the invention. The number of the alterations to be combined is, for example, 2 or more and 30 or less, preferably 2 or more and 25 or less, 2 or more and 22 or less, 2 or more and 20 or less, 2 or more and 15 or less, 2 or more and 10 or less, 2 or more and 5 or less, or 2 or more and 3 or less.

The plurality of amino acid alterations to be combined may be added to only the antibody heavy chain variable domain or light chain variable domain or may be appropriately distributed to both of the heavy chain variable domain and the light chain variable domain. One or more amino acid residues in the variable region are acceptable as the amino acid residue to be altered as long as the antigen-binding activity is maintained. In the case of altering an amino acid in the variable region, the resulting variable region preferably maintains the binding activity of the corresponding unaltered antibody and preferably has, for example, 50% or higher, more preferably 80% or higher, further preferably 100% or higher, of the binding activity before the alteration, though the variable region according to the present invention is not limited thereto. The binding activity may be increased by the amino acid alteration and may be, for example, 2 times, 5 times, or 10 times the binding activity before the alteration.

Examples of the region preferred for the amino acid alteration include solvent-exposed regions and loops in the variable region. Among others, CDR1, CDR2, CDR3, FR3, and loops are preferred. Specifically. Kabat numbering positions 31 to 35, 50 to 65, 71 to 74, and 95 to 102 in the heavy (H) chain variable domain and Kabat numbering positions 24 to 34, 50 to 56, and 89 to 97 in the light (L) chain variable domain are preferred Kabat numbering positions 31, 52a to 61, 71 to 74, and 97 to 101 in the heavy (H) chain variable domain and Kabat numbering positions 24 to 34, 51 to 56, and 89 to 96 in the light (L) chain variable domain are more preferred. Also, an amino acid that increases antigen-binding activity may be further introduced at the time of the amino acid alteration.

In the present invention, the term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs; three in the VH (H1, H2, H3), and three in the VL (L1, L2. L3). Exemplary HVRs herein include;

(a) hypervariable loops occurring at amino acid residues 26-32 (L1), 50-52 (L2), 91-96 (L3), 26-32 (H1), 53-55 (H2), and 96-101 (H3) (Chothia and Lesk. J. Mol. Biol. 196:901-917 (1987));
(b) CDRs occurring at amino acid residues 24-34 (L1), 50-56 (L2), 89-97 (L3), 31-35b (H1), 50-65 (H2), and 95-102 (H3) (Kabat et al., Sequences of Proteins of Immunological Interest, 5th Ed. Public Health Service. National Institutes of Health, Bethesda, MD (1991));
(c) antigen contacts occurring at amino acid residues 27c-36 (L1), 46-55 (L2), 89-96 (L3), 30-35b (H1), 47-58 (H2), and 93-101 (H3) (MacCallum et al. J. Mol. Biol. 262:732-745 (1996)); and
(d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise indicated, HVR residues and other residues in the variable domain (e.g., FR residues) are numbered herein according to Kabat et al., supra.

In the present invention, the "loop" means a region containing residues that are not involved in the maintenance of an immunoglobulin beta barrel structure.

In the present invention, the amino acid alteration means substitution, deletion, addition, insertion, or modification, or a combination thereof. In the present invention, the amino acid alteration can be used interchangeably with amino acid mutation and used in the same sense therewith.

The substitution of an amino acid residue is carried out by replacement with another amino acid residue for the purpose of altering, for example, any of the following (a) to (c): (a) the polypeptide backbone structure of a region having a sheet structure or helix structure; (b) the electric charge or hydrophobicity of a target site; and (c) the size of a side chain.

Amino acid residues are classified into the following groups on the basis of general side chain properties: (1) hydrophobic residues: norleucine, Met, Ala, Val, Leu, and Ile; (2) neutral hydrophilic residues: Cys, Ser, Thr, Asn, and Gln; (3) acidic residues: Asp and Glu; (4) basic residues: His, Lys, and Arg; (5) residues that influence chain orientation: Gly and Pro; and (6) aromatic residues: Trp, Tyr, and Phe.

The substitution of amino acid residues within each of these groups is called conservative substitution, while the substitution of an amino acid residue in one of these groups by an amino acid residue in another group is called non-conservative substitution. The substitution according to the present invention may be the conservative substitution or may be the non-conservative substitution. Alternatively, the conservative substitution and the non-conservative substitution may be combined.

The alteration of an amino acid residue also includes: the selection of a variable region that is capable of binding to the first antigen and the second antigen, but cannot bind to these antigens at the same time, from those obtained by the random alteration of amino acids whose alteration does not cancel the binding to the antigen, in the antibody variable region binding to the first antigen or the second antigen; and alteration to insert a peptide previously known to have binding activity against the desired antigen, to the region mentioned above.

Examples of the peptide previously known to have binding activity against the desired antigen include peptides shown in the following table.

[Table A]

TABLE A

| Binding partner; protein of interest | References |
|---|---|
| VEGFR | J Biol Chem. 2002 Nov. 8; 277(45): 43137-42. Epub 2002 Aug 14. EMBO J. 2000 Apr 3; 19(7): 1525-33., J Med Chem. 2010 Jun. 10; 53(11): 4428-40. |
| TNFR | Mol Immunol. 2004 Jul.; 41(8): 741-9., Eur J Pharmacol. 2011 Apr 10; 656 (1-3): 119-24. |
| TLR5 | J Immunol 2010; 185; 1744-1754 |
| TLR4 | PLoS ONE, February 2012\| Volume 7\|Issue 2\|e30839 |
| TLR2 | WO2006/083706A2, |
| T cell VLA receptor | Int Immunopharmacol. 2003 Mar.; 3 (3): 435-43. |
| PDGFR | Biochemical Pharmacology (2003), 66 (7), 1307-1317, FEBS Lett. 1997 Dec 15; 419 (2-3): 166-70 |
| Naip5(NLR) | NATURE IMMUNOLOGY VOLUME 9 NUMBER 10 OCT. 2008 1171- |
| Integrin | WO 95/14714, WO 97/08203, WO 98/10795, WO 99/24462, J. Biol, Chem. 274: 1979-1985 |
| FcgRIIa | J Biol Chem. 2009 Jan. 9; 284(2): 1126-35 |
| EGFR | Journal of Biotechnology (2005), 116 (3) 211-219 |
| DR5 agonist | Journal of Biotechnology (2006), 361(3) 522-536 |
| CXCR4 | Science 330, 1066 (2010); Vol. 330 no. 6007 pp. 1066-1071 |
| CD40 | Eur J Biochem. 2003 May; 270 (10): 2287-94. |
| CD154 | J Mol Med (Berl). 2009 Feb; 87 (2): 181-97. |
| CD3 | antibody OKT3 (see e.g. Kung, P. et al, Science 206 (1979) 347-349; Salmeron, A. et al, J Immunol 147 (1991) 3047-3052), antibody UCHT1 (see e.g. Callard,R.E. et al, Clin Exp Immunol 43 (1981) 497-505) , antibody SP34 (see e.g. Pessano, S. et al, EMBO J 4 (1985) 337-344). |
| TNFR superfamily | |
| CD137 | Cancer Immunol Immunother (2012) 61:1721-1733; US8716452B2; US20160244528A1; Sanmamed et al. Cancer Res; 75(17) Sep. 1, 2015 Urelumab (CAS Registry No. 934823-49-1) and its variants described in WO2005/035584A1; Utomilumab (CAS Registry No. 1417318-27-4) and its variants described in WO2012/032433A1 |
| OX40 (CD134) | US7550140B2; WO2015153513A8; WO2018112346A1 |
| GITR | US8709424B2; Cohen et al. (2006) Cancer Res. 66(9):4904-12; WO2013039954A1; WO2017214548A1; US9464139B2 |
| CD30 | British Journal of Cancer (2000) 83(2), 252-260; US7973136B2; Borchmann, Peter, et al. Blood 102.10 (2003): 3737-3742. |
| DR3 | WO2011106707A2; US7708996B2 |
| HVEM | US20100203047A1 |

Several antibodies that bind to different epitopes of human CD3 epsilon are known in the art, e.g, the antibody OKT3 (see e.g. Kung, P. et al, Science 206 (1979) 347-349: Salmeron, A. et al, J Immunol 147 (1991) 3047-3052; U.S. Pat. No. 9,226,962B2), the antibody UCHT1 (see e.g. Callard, R. E. et al, Clin Exp Immunol 43 (1981) 497-505; Arnett et al. PNAS 2004) or the antibody SP34 (human cynomolgus CD3 cross-reactive; see e g. Pessano. S. et al. EMBO J 4 (1985) 337-344. Conrad M. L., et, al, Cytometry A 71 (2007) 925-933). WO2015181098A1 also discloses human cynomolgus cross-reactive antibody specifically binds to human and cynomolgus T cells, activates human T cells and does not bind to the same epitope as the antibody OKT3, the antibody UCHT1 and/or antibody the SP34.

WO2015068847A1 (incorporated by reference herein) discloses methods of preparing Dual-Fab and examples of peptides known to be able to bind to different proteins-of interest, where such peptides could serve as second antigen-binding sites when inserted into a variable region of an antibody binding to a first antigen such as human CD3. Specifically, WO2015068847A1 discloses in, Example 3—anti-CD3 antibodies that bind to integrin and to CD3, but not at the same time.

Example 4—anti-CD3 antibodies that bind to TLR2 and to CD3, but not at the same time.

Example 8—anti-CD3 antibodies that bind to IgA and to CD3, but not at the same time.

Example 9—anti-CD3 antibodies that bind to CD154 and to CD3, but not at the same time.

In addition, WO2015068847A1 discloses many sites within heavy and light variable regions where antigen-binding sites can be located without abolishing the first antigen-binding site's ability to bind to CD3. See the working examples described above, as well as the experiments described in Example 6, in which GGS peptides of various lengths (3, 6, or 9 residues) were inserted into three different VH sites (in CDR2. FR3, or CDR3).

In the present invention, the alteration in the heavy chain variable (VH) and/or light chain variable (VL) region(s) as described above may be combined with alteration known in the art. For example, the modification of N-terminal glutamine of the variable region to pyroglutamic acid by pyroglutamylation is a modification well known to those skilled in the art. Thus, the antigen-binding molecule of the present invention having glutamine at the N terminus of its heavy chain variable (VH) region may contain a variable region with this N-terminal glutamine modified to pyroglutamic acid.

In the present invention, a heavy chain variable (VH) region and/or light chain variable (VL) region in an antigen-binding domain of an antigen binding molecule may further have amino acid alteration to improve, for example, antigen binding, pharmacokinetics, stability, or antigenicity. In the present invention, a heavy chain variable (VH) region and/or light chain variable (VL) region in an antigen-binding domain of an antigen binding molecule may be altered so as to have pH dependent binding activity against an antigen and be thereby capable of repetitively binding to the antigen (WO2009/125825).

Also, in the present invention, amino acid alteration to change antigen-binding activity according to the concentration of a target tissue-specific compound (WO2013/180200) may be added to, for example, such a heavy chain variable (VH) region and/or light chain variable (VL) region in a third antigen-binding domain of an antigen binding molecule binding to a third antigen (e.g., tumor antigen).

In the present invention, a heavy chain variable (VH) region and/or light chain variable (VL) region in an antigen-binding domain of an antigen binding molecule may be further altered for the purpose of, for example, enhancing binding activity, improving specificity, reducing pI, conferring pH-dependent antigen-binding properties, improving the thermal stability of binding, improving solubility, improving stability against chemical modification, improving heterogeneity derived from a sugar chain, avoiding a T cell epitope identified by use of in silico prediction or in vitro T cell-based assay for reduction in immunogenicity, or introducing a T cell epitope for activating regulatory T cells (mAbs 3: 243-247, 2011).

In the present invention, whether an antigen-binding domain and/or an antigen binding molecule of the present invention is capable of binding to an antigen and "capable of binding to an antigen but does not bind to any other antigen can be determined by a method known in the art. This can be determined by, for example, an electrochemiluminescence method (ECL method) (BMC Research Notes 2011, 4: 281).

Specifically, for example, as for a low-molecular antigen-binding molecule of the present invention, a biotin-labeled antigen-binding molecule to be tested is mixed with an antigen (e.g., each of the first, second or third antigen) labeled with sulfo-tag (Ru complex), and the mixture is added onto a streptavidin-immobilized plate. In this operation, the biotin-labeled antigen-binding molecule to be tested binds to streptavidin on the plate. Light is developed from the sulfo-tag, and the luminescence signal can be detected using Sector Imager 600 or 2400 (MSD K.K.) or the like to thereby confirm the binding of the aforementioned antigen-binding molecule to be tested to the antigen (e.g., each of the first, second or third antigen).

Alternatively, this assay may be conducted by ELISA. FACS (fluorescence activated cell sorting), ALPHAScreen (amplified luminescent proximity homogeneous assay screen), the BIACORE method based on a surface plasmon resonance (SPR) phenomenon, etc. (Proc. Natl. Acad. Sci. USA (2006) 103 (11), 4005-4010).

Specifically, the assay can be conducted using, for example, an interaction analyzer Biacore (GE Healthcare Japan Corp.) based on a surface plasmon resonance (SPR) phenomenon. The Biacore analyzer includes any model such as Biacore T100, T200, X100, A100, 4000, 3000, 2000, 1000, or C. Any sensor chip for Biacore, such as a CM7, CM5, CM4, CM3, C1, SA, NTA, L1, HPA, or Au chip, can be used as a sensor chip. Proteins for capturing the antigen-binding molecule of the present invention, such as protein A, protein G, protein L, anti-human IgG antibodies, anti-human IgG-Fab, anti-human L chain antibodies, anti-human Fc antibodies, antigenic proteins, or antigenic peptides, are immobilized onto the sensor chip by a coupling method such as amine coupling, disulfide coupling, or aldehyde coupling. The antigen (e.g., each of the first antigen, the second antigen, or the third antigen) is injected thereon as an analyte, and the interaction is measured to obtain a sensorgram. In this operation, the concentration of the antigen (e.g., the first antigen, the second antigen, or the third antigen) can be selected within the range of a few micro M to a few pM according to the interaction strength (e.g., KD) of the assay sample.

Alternatively, an antigen (e.g., the first antigen, the second antigen, or the third antigen) may be immobilized instead of the antigen-binding molecule onto the sensor chip, with which the antigen-binding molecule sample to be evaluated is in turn allowed to interact. Whether an antigen-binding domain and/or an antigen binding molecule of the present invention has binding activity against an antigen (e.g., the first antigen, the second antigen, or the third antigen) can be confirmed on the basis of a dissociation constant (KD) value calculated from the sensorgram of the interaction or on the basis of the degree of increase in the sensorgram after the action of the antigen-binding molecule sample over the level before the action.

In some embodiments, binding affinity of the antigen-binding molecules (antibodies) of the present invention to an antigen (e.g. CD3, CD137) are assessed at 25 degrees C., or 37 degrees C. using e.g., Biacore T200 instrument (GE Healthcare). Anti-human Fc (e.g., GE Healthcare) is immobilized onto all flow cells of a CM4 sensor chip using amine coupling kit (e.g., GE Healthcare). Antigen-binding molecules (antibodies) are captured onto the anti-Fc sensor surfaces, then the antigen (e.g. recombinant human CD3 or CD137) is injected over the flow cell. All antigen-binding molecules (antibodies) and analytes are prepared in ACES pH 7.4 containing 20 mM ACES, 150 mM NaCl, 0.05% Tween 20, 0.005% NaN3. Sensor surface is regenerated each cycle with 3M MgCl2. Binding affinity are determined by processing and fitting the data to 1:1 binding model using e.g., Biacore T200 Evaluation software, version 2.0 (GE Healthcare). In some embodiments, CD3 binding affinity assay is conducted in same condition with assay temperature is set at 25 degrees C., and CD137 binding affinity assay is conducted in same condition except assay temperature is set at 37 degrees C.

The ALPHAScreen is carried out by the ALPHA technology using two types of beads (donor and acceptor) on the basis of the following principle: luminescence signals are detected only when these two beads are located in proximity through the biological interaction between a molecule bound with the donor bead and a molecule bound with the acceptor bead. A laser-excited photosensitizer in the donor bead converts ambient oxygen to singlet oxygen having an excited state. The singlet oxygen diffuses around the donor bead and reaches the acceptor bead located in proximity thereto to thereby cause chemiluminescent reaction in the bead, which finally emits light. In the absence of the interaction between the molecule bound with the donor bead and the molecule bound with the acceptor bead, singlet oxygen produced by the donor bead does not reach the acceptor bead. Thus, no chemiluminescent reaction occurs.

One (ligand) of the substances between which the interaction is to be observed is immobilized onto a thin gold film of a sensor chip. The sensor chip is irradiated with light from the back such that total reflection occurs at the interface between the thin gold film and glass. As a result, a site having a drop in reflection intensity (SPR signal) is formed in a portion of reflected light. The other (analyte) of the substances between which the interaction is to be observed is injected on the surface of the sensor chip. Upon binding of the analyte to the ligand, the mass of the immobilized ligand molecule is increased to change the refractive index of the solvent on the sensor chip surface. This change in the refractive index shifts the position of the SPR signal (on the contrary, the dissociation of the bound molecules gets the signal back to the original position). The Biacore system plots on the ordinate the amount of the shift, i.e., change in mass on the sensor chip surface, and displays time-dependent change in mass as assay data (sensorgram). The amount of the analyte bound to the ligand captured on the sensor chip surface (amount of change in response on the sensorgram between before and after the interaction of the analyte) can be determined from the sensorgram. However, since the amount bound also depends on the amount of the ligand, the comparison must be performed under conditions where substantially the same amounts of the ligand are used. Kinetics, i.e., an association rate constant (ka) and a dissociation rate constant (kd), can be determined from the curve of the sensorgram, while affinity (KD) can be determined from the ratio between these constants. Inhibition assay is also preferably used in the BIACORE method. Examples of the inhibition assay are described in Proc. Natl. Acad. Sci. USA (2006) 103 (11), 4005-4010.

Whether the antigen-binding molecule of the present invention does "not bind to the first antigen and the second antigen at the same time" can be confirmed by: confirming the antigen-binding molecule to have binding activity against both the first antigen and the second antigen; then allowing either the first antigen or the second antigen to bind in advance to the antigen-binding molecule comprising the variable region having this binding activity; and then determining the presence or absence of its binding activity against the other one by the method mentioned above. Alternatively, this can also be confirmed by determining whether the binding of the antigen-binding molecule to either the first antigen or the second antigen immobilized on an ELISA plate or a sensor chip is inhibited by the addition of the other one into the solution. In some embodiments, the binding of the antigen-binding molecule of the present invention to either the first antigen or the second antigen is inhibited by binding of the antigen-binding molecule to the other by at least 50%, preferably 60% or more, more preferably 70% or more, more preferably 80% or more, further preferably 90% or more, or even more preferably 95% or more.

In one aspect, while one antigen (e.g, the first antigen) is immobilized, the inhibition of the binding of the antigen-binding molecule to the first antigen can be determined in the presence of the other antigen (e.g, the second antigen) by methods known in prior art (i.e. ELISA, BIACORE, and so on). In another aspect, while the second antigen is immobilized, the inhibition of the binding of the antigen-binding molecule to the second antigen also can be determined in the presence of the first antigen. When either one of two aspects mentioned above is conducted, the antigen-binding molecule of the present invention is determined not to bind to the first antigen and the second antigen at the same time if the binding is inhibited by at least 50%, preferably 60% or more, preferably 70% or more, further preferably 80% or more, further preferably 90% or more, or even more preferably 95% or more.

In some embodiments, the concentration of the antigen injected as an analyte is at least 1-fold, 2-fold, 5-fold, 10-fold, 30-fold, 50-fold, or 100-fold higher than the concentration of the other antigen to be immobilized.

In preferable manner, the concentration of the antigen injected as an analyte is 100-fold higher than the concentration of the other antigen to be immobilized and the binding is inhibited by at least 80%.

In one embodiment, the ratio of the KD value for the first antigen (analyte)-binding activity of the antigen-binding molecule to the second antigen (immobilized)-binding activity of the antigen-binding molecule (KD (first antigen)/KD (second antigen)) is calculated and the first antigen (analyte) concentration which is 10-fold, 50-fold, 100-fold, or 200-fold of the ratio of the KD value (KD (first antigen)/KD (second antigen) higher than the second antigen (immobilized) concentration can be used for the competition measurement above. (e.g. 1-fold, 5-fold, 10-fold, or 20-fold higher concentration can be selected when the ratio of the KD value is 0.1. Furthermore, 100-fold, 500-fold, 1000-fold, or 2000-fold higher concentration can be selected when the ratio of the KD value is 10.)

In one aspect, while one antigen (e.g. first antigen) is immobilized, the attenuation of the binding signal of the antigen-binding molecule to the first antigen can be determined in the presence of the other antigen (e.g. second antigen) by methods known in prior art (i.e. ELISA, ECL and so on). In another aspect, while the second antigen is immobilized, the attenuation of the binding signal of the antigen-binding molecule to the second antigen also can be determined in the presence of the first antigen. When either one of two aspects mentioned above is conducted, the antigen-binding molecule of the present invention is determined not to bind to the first antigen and the second antigen at the same time if the binding signal is attenuated by at least 50%, preferably 60% or more, preferably 70% or more, further preferably 80% or more, further preferably 90% or more, or even more preferably 95% or more. (see Reference Examples 2-5, 3-9, and 4-4)

In some embodiments, the concentration of the antigen injected as an analyte is at least 1-fold, 2-fold, 5-fold, 10-fold, 30-fold, 50-fold, or 100-fold higher than the concentration of the other antigen to be immobilized.

In preferable manner, the concentration of the antigen injected as an analyte is 100-fold higher than the concentration of the other antigen to be immobilized and the binding is inhibited by at least 80%.

In one embodiment, the ratio of the KD value for the first antigen (analyte)-binding activity of the antigen-binding molecule to the second antigen (immobilized)-binding activity of the antigen-binding molecule (KD (first antigen)/KD (second antigen)) is calculated and the first antigen (analyte) concentration which is 10-fold, 50-fold, 100-fold, or 200-fold of the ratio of the KD value (KD (first antigen)/KD (second antigen) higher than the second antigen (immobilized) concentration can be used for the measurement above. (e.g. 1-fold, 5-fold, 10-fold, or 20-fold higher concentration can be selected when the ratio of the KD value is 0.1. Furthermore, 100-fold, 500-fold, 1000-fold, or 2000-fold higher concentration can be selected when the ratio of the KD value is 10.)

Specifically, in the case of using, for example, the ECL method, a biotin-labeled antigen-binding molecule to be tested, the first antigen labeled with sulfo-tag (Ru complex), and an unlabeled second antigen are prepared. When the antigen-binding molecule to be tested is capable of binding to the first antigen and the second antigen, but does not bind to the first antigen and the second antigen at the same time, the luminescence signal of the sulfo-tag is detected in the absence of the unlabeled second antigen by adding the mixture of the antigen-binding molecule to be tested and labeled first antigen onto a streptavidin-immobilized plate, followed by light development. By contrast, the luminescence signal is decreased in the presence of unlabeled second antigen. This decrease in luminescence signal can be quantified to determine relative binding activity. This analysis may be similarly conducted using the labeled second antigen and the unlabeled first antigen.

In the case of the ALPHAScreen, the antigen-binding molecule to be tested interacts with the first antigen in the absence of the competing second antigen to generate signals of 520 to 620 nm. The untagged second antigen competes with the first antigen for the interaction with the antigen-binding molecule to be tested. Decrease in fluorescence caused as a result of the competition can be quantified to thereby determine relative binding activity. The polypeptide biotinylation using sulfo-NHS-biotin or the like is known in the art. The first antigen can be tagged with GST by an appropriately adopted method which involves, for example: fusing a polynucleotide encoding the first antigen in flame with a polynucleotide encoding GST; and allowing the resulting fusion gene to be expressed by cells or the like harboring vectors capable of expression thereof, followed by purification using a glutathione column. The obtained signals are preferably analyzed using, for example, software GRAPHPAD PRISM (GraphPad Software, Inc., San Diego) adapted to a one-site competition model based on nonlinear regression analysis. This analysis may be similarly conducted using the tagged second antigen and the untagged first antigen.

Alternatively, a method using fluorescence resonance energy transfer (FRET) may be used. FRET is a phenomenon in which excitation energy is transferred directly between two fluorescent molecules located in proximity to each other by electron resonance. When FRET occurs, the excitation energy of a donor (fluorescent molecule having an excited state) is transferred to an acceptor (another fluorescent molecule located near the donor) so that the fluorescence emitted from the donor disappears (to be precise, the lifetime of the fluorescence is shortened) and instead, the fluorescence is emitted from the acceptor. By use of this phenomenon, whether or not bind to the first antigen and the second antigen at the same time can be analyzed. For example, when the first antigen carrying a fluorescence donor and the second antigen carrying a fluorescence acceptor bind to the antigen-binding molecule to be tested at the same time, the fluorescence of the donor disappears while the fluorescence is emitted from the acceptor. Therefore, change in fluorescence wavelength is observed. Such an antibody is confirmed to bind to the first antigen and the second antigen at the same time. On the other hand, if the mixing of the first antigen, the second antigen, and the antigen-binding molecule to be tested does not change the fluorescence wavelength of the fluorescence donor bound with the first antigen, this antigen-binding molecule to be tested can be regarded as antigen binding domain that is capable of binding to the first antigen and the second antigen, but does not bind to the first antigen and the second antigen at the same time.

For example, a biotin-labeled antigen-binding molecule to be tested is allowed to bind to streptavidin on the donor bead, while the first antigen tagged with glutathione S transferase (GST) is allowed to bind to the acceptor bead. The antigen-binding molecule to be tested interacts with the first antigen in the absence of the competing second antigen to generate signals of 520 to 620 nm. The untagged second antigen competes with the first antigen for the interaction with the antigen-binding molecule to be tested. Decrease in fluorescence caused as a result of the competition can be quantified to thereby determine relative binding activity. The polypeptide biotinylation using sulfo-NHS-biotin or the like is known in the art. The first antigen can be tagged with GST by an appropriately adopted method which involves, for example: fusing a polynucleotide encoding the first antigen in flame with a polynucleotide encoding GST; and allowing the resulting fusion gene to be expressed by cells or the like harboring vectors capable of expression thereof, followed by purification using a glutathione column. The obtained signals are preferably analyzed using, for example, software GRAPHPAD PRISM (GraphPad Software, Inc., San Diego) adapted to a one-site competition model based on nonlinear regression analysis.

The tagging is not limited to the GST tagging and may be carried out with any tag such as, but not limited to, a histidine tag, MBP, CBP, a Flag tag, an HA tag, a VS tag, or a c-myc tag. The binding of the antigen-binding molecule to be tested to the donor bead is not limited to the binding using biotin-streptavidin reaction. Particularly, when the antigen-binding molecule to be tested comprises Fc, a possible method involves allowing the antigen-binding molecule to be tested to bind via an Fe-recognizing protein such as protein A or protein G on the donor bead.

Also, the case where the variable region is capable of binding to the first antigen and the second antigen at the same time when the first antigen and the second antigen are not expressed on cell membranes, as with soluble proteins, or both reside on the same cell, but cannot bind to the first antigen and the second antigen each expressed on a different cell, at the same time can also be as saved by a method known in the art.

Specifically, the antigen-binding molecule to be tested has been confirmed to be positive in ECL-ELISA for detecting binding to the first antigen and the second antigen at the same time is also mixed with a cell expressing the first antigen and a cell expressing the second antigen. The antigen-binding molecule to be tested can be shown to be incapable of binding to the first antigen and the second antigen expressed on different cells, at the same time unless the antigen-binding molecule and these cells bind to each other at the same time. This assay can be conducted by, for example, cell-based ECL-ELISA. The cell expressing the first antigen is immobilized onto a plate in advance. After binding of the antigen-binding molecule to be tested thereto, the cell expressing the second antigen is added to the plate. A different antigen expressed only on the cell expressing the second antigen is detected using a sulfo-tag-labeled antibody against this antigen. A signal is observed when the antigen-binding molecule binds to the two antigens respectively expressed on the two cells, at the same time. No signal is observed when the antigen-binding molecule does not bind to these antigens at the same time.

Alternatively, this assay may be conducted by the ALPHAScreen method. The antigen-binding molecule to be tested is mixed with a cell expressing the first antigen bound with the donor bead and a cell expressing the second antigen bound with the acceptor bead. A signal is observed when the antigen-binding molecule binds to the two antigens expressed on the two cells respectively, at the same time. No signal is observed when the antigen-binding molecule does not bind to these antigens at the same time. Alternatively, this assay may also be conducted by an Octet interaction analysis method. First, a cell expressing the first antigen tagged with a peptide tag is allowed to bind to a biosensor that recognizes the peptide tag. A cell expressing the second antigen and the antigen-binding molecule to be tested are placed in wells and analyzed for interaction. A large wavelength shift caused by the binding of the antigen-binding molecule to be tested and the cell expressing the second antigen to the biosensor is observed when the antigen-binding molecule binds to the two antigens expressed on the two cells respectively, at the same time. A small wavelength shift caused by the binding of only the antigen-binding molecule to be tested to the biosensor is observed when the antigen-binding molecule does not bind to these antigens at the same time.

Instead of these methods based on the binding activity, assay based on biological activity may be conducted. For example, a cell expressing the first antigen and a cell expressing the second antigen are mixed with the antigen-binding molecule to be tested, and cultured. The two antigens expressed on the two cells respectively are mutually activated via the antigen-binding molecule to be tested when the antigen-binding molecule binds to these two antigens at the same time. Therefore, change in activation signal, such as increase in the respective downstream phosphorylation levels of the antigens, can be detected. Alternatively, cytokine production is induced as a result of the activation Therefore, the amount of cytokines produced can be measured to thereby confirm whether or not to bind to the two cells at the same time. Alternatively, cytotoxicity against a cell expressing the second antigen is induced as a result of the activation. Alternatively, the expression of a reporter gene is induced by a promoter which is activated at the downstream of the signal transduction pathway of the second antigen or the first antigen as a result of the activation. Therefore, the cytotoxicity or the amount of reporter proteins produced can be measured to thereby confirm whether or not to bind to the two cells at the same time.

In the present invention, an Fc region derived from, for example, naturally occurring IgG can be used as the "Fc region" of the present invention. In this context, the naturally occurring IgG means a polypeptide that contains an amino acid sequence identical to that of IgG found in nature and belongs to a class of an antibody substantially encoded by an immunoglobulin gamma gene. The naturally occurring human IgG means, for example, naturally occurring human IgG1, naturally occurring human IgG2, naturally occurring human IgG3, or naturally occurring human IgG4. The naturally occurring IgG also includes variants or the like spontaneously derived therefrom. A plurality of allotype sequences based on gene polymorphism are described as the constant regions of human IgG1, human IgG2, human IgG3, and human IgG4 antibodies in Sequences of proteins of immunological interest, NIH Publication No. 91-3242, any of which can be used in the present invention. Particularly, the sequence of human IgG1 may have DEL or EEM as an amino acid sequence of EU numbering positions 356 to 358.

The antibody Fc region is found as, for example, an Fc region of IgA1, IgA2, IgD, IgE, IgG1, IgG2, IgG3, IgG4, or IgM type. For example, an Fc region derived from a naturally occurring human IgG antibody can be used as the antibody Fc region of the present invention. For example, an Fc region derived from a constant region of naturally occurring IgG, specifically, a constant region (SEQ ID NO: 498) originated from naturally occurring human IgG1, a constant region (SEQ ID NO: 499) originated from naturally occurring human IgG2, a constant region (SEQ ID NO: 500) originated from naturally occurring human IgG3, or a constant region (SEQ ID NO: 501) originated from naturally occurring human IgG4 can be used as the Fc region of the present invention. The constant region of naturally occurring IgG also includes variants or the like spontaneously derived therefrom.

The Fc region of the present invention is particularly preferably an Fc region having reduced binding activity against an Fc gamma receptor. In this context, the Fc gamma receptor (also referred to as Fc gamma R herein) refers to a receptor capable of binding to the Fc region of IgG1, IgG2, IgG3, or IgG4 and means any member of the protein family substantially encoded by Fc gamma receptor genes. In humans, this family includes, but is not limited to: Fc gamma RI (CD64) including isoforms Fc gamma RIa. Fc gamma RIb, and Fc gamma RIc: Fc gamma RII (CD32) including isoforms Fc gamma RIIa (including allotypes H131 (H type) and R131 (R type)). Fc gamma RIIb (including Fc gamma RIIb-1 and Fc gamma RIIb-2), and Fc gamma RIIc; and Fc gamma RIII (CD16) including isoforms Fe gamma RIIIa (including allotypes V158 and F158) and Fc gamma RIIIb (including allotypes Fc gamma RIIIb-NA1 and Fc gamma RIIlb-NA2); and any yet-to-be-discovered human Fe gamma R or Fc gamma R isoform or allotype. The Fc gamma R includes those derived from humans, mice, rats, rabbits, and monkeys. The Fc gamma R is not limited to these molecules and may be derived from any organism. The mouse Fc gamma Rs include, but are not limited to, Fe gamma R1 (CD64), Fc gamma RII (CD32), Fc gamma RIII (CD16), and Fc gamma RIII-2 (CD16-2), and any yet-to-be-discovered mouse Fc gamma R or Fc gamma R isoform or allotype. Preferred examples of such Fc gamma receptors include human Fc gamma RI (CD64), Fc gamma RIIa (CD32), Fc gamma RIIb (CD32), Fc gamma RIIIa (CD16), and/or Fc gamma RIIIb (CD16).

The Fc gamma R is found in the forms of an activating receptor having ITAM (immunoreceptor tyrosine-based activation motif) and an inhibitory receptor having ITIM (immunoreceptor tyrosine-based inhibitory motif). The Fc gamma R is classified into activating Fc gamma R (Fc gamma RI, Fc gamma RIIa R, Fc gamma RIIa H, Fc gamma RIIIa, and Fc gamma RIIIb) and inhibitory Fc gamma R (Fc gamma RIIb). The polynucleotide sequence and the amino acid sequence of Fe gamma RI are described in NM_000566.3 and NP_000557.1, respectively; the polynucleotide sequence and the amino acid sequence of Fc gamma RIIa are described in BC020823.1 and AAH20823.1, respectively: the polynucleotide sequence and the amino acid sequence of Fc gamma RIIb are described in BC146678.1 and AA146679.1, respectively; the polynucleotide sequence and the amino acid sequence of Fc gamma Rilla are described in BC033678.1 and AAH33678.1, respectively; and the polynucleotide sequence and the amino acid sequence of Fc gamma RIIIb are described in BC128562.1 and AAI28563.1, respectively (RefSeq registration numbers). Fc gamma RIIa has two types of gene polymorphisms that substitute the 131st amino acid of Fc gamma RIIa by histidine (H type) or arginine (R type) (J. Exp. Med. 172, 19-25, 1990). Fc gamma RIIb has two types of gene polymorphisms that substitute the 232nd amino acid of Fc gamma RIIb by isoleucine (1 type) or threonine (T type) (Arthritis. Rheum. 46:1242-1254 (2002)). Fc gamma RIIIa has two types of gene polymorphisms that substitute the 158th amino acid of Fc gamma RIIIa by valine (V type) or phenylalanine (F type) (J. Clin. Invest. 100 (5): 1059-1070 (1997)). Fc gamma RIIIb has two types of gene polymorphisms (NA1 type and NA2 type) (J. Clin. Invest. 85:1287-1295 (1990)).

The reduced binding activity against an Fc gamma receptor can be confirmed by a well-known method such as FACS, ELISA format, ALPHAScreen (amplified luminescent proximity homogeneous assay screen), or the BIACORE method based on a surface plasmon resonance (SPR) phenomenon (Proc. Natl. Acad. Sci. USA (2006) 103 (11), 4005-4010).

The ALPHAScreen method is carried out by the ALPHA technology using two types of beads (donor and acceptor) on the basis of the following principle: luminescence signals are detected only when these two beads are located in proximity through the biological interaction between a molecule bound with the donor bead and a molecule bound with the acceptor bead. A laser-excited photosensitizer in the donor bead converts ambient oxygen to singlet oxygen having an excited state. The singlet oxygen diffuses around the donor bead and reaches the acceptor bead located in proximity thereto to thereby cause chemiluminescent reaction in the bead, which finally emits light. In the absence of the interaction between the molecule bound with the donor bead and the molecule bound with the acceptor bead, singlet oxygen produced by the donor bead does not reach the acceptor bead. Thus, no chemiluminescent reaction occurs.

For example, a biotin-labeled antigen-binding molecule is allowed to bind to the donor bead, while a glutathione S transferase (GST)-tagged Fc gamma receptor is allowed to bind to the acceptor bead. In the absence of a competing antigen-binding molecule having a mutated Fc region, an antigen-binding molecule having a wild-type Fc region interacts with the Fc gamma receptor to generate signals of 520 to 620 nm. The untagged antigen-binding molecule having a mutated Fc region competes with the antigen-binding molecule having a wild-type Fc region for the interaction with the Fc gamma receptor. Decrease in fluorescence caused as a result of the competition can be quantified to thereby determine relative binding affinity. The antigen-binding molecule (e.g., antibody) biotinylation using sulfo-NHS-biotin or the like is known in the art. The Fc gamma receptor can be tagged with GST by an appropriately adopted method which involves, for example: fusing a polynucleotide encoding the Fc gamma receptor in flame with a polynucleotide encoding GST; and allowing the resulting fusion gene to be expressed by cells or the like harboring vectors capable of expression thereof, followed by purification using a glutathione column. The obtained signals are preferably analyzed using, for example, software GRAPHPAD PRISM (GraphPad Software, Inc., San Diego) adapted to a one-site competition model based on nonlinear regression analysis.

One (ligand) of the substances between which the interaction is to be observed is immobilized onto a thin gold film of a sensor chip. The sensor chip is irradiated with light from the back such that total reflection occurs at the interface between the thin gold film and glass. As a result, a site having a drop in reflection intensity (SPR signal) is formed in a portion of reflected light. The other (analyte) of the substances between which the interaction is to be observed is injected on the surface of the sensor chip. Upon binding of the analyte to the ligand, the mass of the immobilized ligand molecule is increased to change the refractive index of the solvent on the sensor chip surface. This change in the refractive index shifts the position of the SPR signal (on the contrary, the dissociation of the bound molecules gets the signal back to the original position). The Biacore system plots on the ordinate the amount of the shift, i.e., change in mass on the sensor chip surface, and displays time-dependent change in mass as assay data (sensorgram). Kinetics, i.e., an association rate constant (ka) and a dissociation rate constant (kd), can be determined from the curve of the sensorgram, while affinity (KD) can be determined from the ratio between these constants. Inhibition assay is also preferably used in the BIACORE method. Examples of the inhibition assay are described in Proc. Natl. Acad. Sci. USA (2006) 103 (11), 4005-4010.

In the present specification, the reduced binding activity against an Fc gamma receptor means that the antigen-binding molecule to be tested exhibits binding activity of, for example, 50% or lower, preferably 45% or lower, 40% or lower, 35% or lower, 30% or lower, 20% or lower, or 15% or lower, particularly preferably 10% or lower, 9% or lower, 8% or lower, 7% or lower, 6% or lower, 5% or lower, 4% or lower, 3% or lower, 2% or lower, or 1% or lower, compared with the binding activity of a control antigen-binding molecule comprising an Fc region on the basis of the analysis method described above.

An antigen-binding molecule having an IgG1, IgG2, IgG3, or IgG4 monoclonal antibody Fc region can be appropriately used as the control antigen-binding molecule. The structure of the Fc region is described in SEQ ID NO: 502 (RefSeq registration No. AAC82527.1 with A added to the N terminus), SEQ ID NO: 503 (RefSeq registration No. AABS9393.1 with A added to the N terminus), SEQ ID NO: 504 (RefSeq registration No. CAA27268.1 with A added to the N terminus), or SEQ ID NO: 505 (RefSeq registration No. AAB59394.1 with A added to the N terminus). In the case of using an antigen-binding molecule having a variant of the Fc region of an antibody of a certain isotype as a test substance, an antigen-binding molecule having the Fc region of the antibody of this certain isotype is used as a control to test the effect of the mutation in the variant on the binding activity against an Fc gamma receptor. The antigen-binding molecule having the Fc region variant thus confirmed to have reduced binding activity against an Fe gamma receptor is appropriately prepared.

For example, a 231A-238S deletion (WO 2009/011941). C226S, C229S. P238S, (C220S) (J. Rheumatol (2007) 34, 11), C226S, C229S (Hum. Antibod. Hybridomas (1990) 1 (1), 47-54), C226S, C229S, E233P, L234V, or L235A (Blood (2007) 109, 1185-1192) (these amino acids are defined according to the EU numbering) variant is known in the art as such a variant.

Preferred examples thereof include antigen-binding molecules having an Fc region derived from the Fc region of an antibody of a certain isotype by the substitution of any of the following constituent amino acids: amino acids at positions 220, 226, 229, 231, 232, 233, 234, 235, 236, 237, 238, 239, 240, 264, 265, 266, 267, 269, 270, 295, 296, 297, 298, 299, 300, 325, 327, 328, 329, 330, 331, and 332 defined according to the EU numbering. The isotype of the antibody from which the Fc region is originated is not particularly limited, and an Fc region originated from an IgG1, IgG2, IgG3, or IgG4 monoclonal antibody can be appropriately used. An Fc region originated from a naturally occurring human IgG1 antibody is preferably used.

For example, an antigen-binding molecule having an Fc region derived from an IgG1 antibody Fc region by any of the following substitution groups of the constituent amino acids (the number represents the position of an amino acid residue defined according to the EU numbering; the one-letter amino acid code positioned before the number represents an amino acid residue before the substitution; and the one-letter amino acid code positioned after the number represents an amino acid residue before the substitution);

(a) L234F, L235E, and P33IS, (b) C226S, C229S, and P238S, (c) C226S and C229S, and (d) C226S, C229S, E233P, L234V, and L235A or by the deletion of an amino acid sequence from positions 231 to 238 defined according to the EU numbering can also be appropriately used.

An antigen-binding molecule having an Fc region derived from an IgG2 antibody Fc region by any of the following substitution groups of the constituent amino acids (the number represents the position of an amino acid residue defined according to the EU numbering; the one-letter amino acid code positioned before the number represents an amino acid residue before the substitution; and the one-letter amino acid code positioned after the number represents an amino acid residue before the substitution);

(e) H268Q, V309L, A330S, and P331S, (f) V234A, (g) G237A, (h) V234A and G237A, (i) A235E and G237A, and (j) V234A, A235E, and G237A defined according to the EU numbering can also be appropriately used.

An antigen-binding molecule having an Fc region derived from an IgG3 antibody Fc region by any of the following substitution groups of the constituent amino acids (the number represents the position of an amino acid residue defined according to the EU numbering; the one-letter amino acid code positioned before the number represents an amino acid residue before the substitution; and the one-letter amino acid code positioned after the number represents an amino acid residue before the substitution);

(k) F241A, (l) D265A, and (m) V264A defined according to the EU numbering can also be appropriately used.

An antigen-binding molecule having an Fc region derived from an IgG4 antibody Fc region by any of the following substitution groups of the constituent amino acids (the number represents the position of an amino acid residue defined according to the EU numbering; the one-letter amino acid code positioned before the number represents an amino acid residue before the substitution; and the one-letter amino acid code positioned after the number represents an amino acid residue before the substitution):

(n) L235A, G237A, and E318A, (o) L235E, and (p) F234A and L235A defined according to the EU numbering can also be appropriately used.

Other preferred examples thereof include antigen-binding molecules having an Fc region derived from the Fc region of a naturally occurring human IgG1 antibody by the substitution of any of the following constituent amino acids; amino acids at positions 233, 234, 235, 236, 237, 327, 330, and 331 defined according to the EU numbering, by an amino acid at the corresponding EU numbering position in the Fc region of the counterpart IgG2 or IgG4.

Other preferred examples thereof include antigen-binding molecules having an Fc region derived from the Fc region of a naturally occurring human IgG1 antibody by the substitution of any one or more of the following constituent amino acids: amino acids at positions 234, 235, and 297 defined according to the EU numbering, by a different amino acid. The type of the amino acid present after the substitution is not particularly limited. An antigen-binding molecule having an Fc region with any one or more of amino acids at positions 234, 235, and 297 substituted by alanine is particularly preferred.

Other preferred examples thereof include antigen-binding molecules having an Fc region derived from an IgG1 antibody Fc region by the substitution of the constituent amino acid at position 265 defined according to the EU numbering, by a different amino acid. The type of the amino acid present after the substitution is not particularly limited. An antigen-binding molecule having an Fc region with an amino acid at position 265 substituted by alanine is particularly preferred.

In some embodiments, antigen-binding molecules may have increased half lives and increased binding to the neonatal Fc receptor (FcRn), which is responsible for the transfer of maternal IgGs to the fetus (Guyer et al, J. Immunol. 117.587 (1976) and Kim et al., J. Immunol. 24:249 (1994)), are described in US2005/0014934A1 (Hinton et al.) Those antigen-binding molecules comprise an Fc region with one or more substitutions therein which increase binding of the Fc region to FeRn. Such Fe variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826). See also. Duncan, Nature 322:738-40 (1988); U.S. Pat. Nos. 5,648,260 and 5,624,821; and WO 1994/29351 concerning other examples of Fc region variants.

In another embodiments, active ingredients may be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition. Osol, A. Ed. (1980). Yet another embodiments, the antigen-binding molecules of the present invention may be also be conjugated with a "heterologous molecule" for example to increase half-life or stability or otherwise improve the antibody. For example, the antibody may be linked to one of a variety of non-proteinaceous polymers, e.g., polyethylene glycol (PEG), polypropylene glycol, polyoxyalkylenes, or copolymers of polyethylene glycol and polypropylene glycol.

Antibody fragments, such as Fab', linked to one or more PEG molecules are an exemplary embodiment of the invention. In yet another embodiments, antigen-binding molecules of the present invention may have improved pharmacokinetics by fusion to domain capable of binding to the neonatal Fc receptor such as an albumin protein, preferably a human serum albumin); see for examples Muller. Dafne, et al. Journal of Biological Chemistry 282.17 (2007): 12650-12660; and Biotechnol Lett (2010) 32.609-622.

In some embodiment of the "antigen-binding molecule" of the present invention can be, for example, a multispecific antigen-binding molecule comprising (i) a first antigen-binding domain, and a second antigen-binding domain which is different from the first antigen-binding domain, which are linked with a Fc region; (ii) a third antigen-binding domain linked at its C-terminus with a N-terminus of a first antigen-binding domain, and a second antigen binding domain which is different from the first antigen-binding domain, which are linked with a Fc region; (iii) a third antigen-binding domain linked at its C-terminus with a N-terminus of a second antigen-binding domain, and a first antigen binding domain which is different from the second antigen-binding domain, which are linked with a Fc region.

A technique of suppressing the unintended association between heavy (H) chains of the first antigen-binding domain and the second antigen-binding domain by introducing electric charge repulsion to the interface between the second constant domains (CH2) or the third constant domains (CH3) of the Fc region (WO2006/106905) can be applied to association for the multispecific antigen-binding molecule.

In the technique of suppressing the unintended association between heavy (H) chains the first antigen-binding domain and the second antigen-binding domain by introducing electric charge repulsion to the CH2 or CH3 interface, examples of amino acid residues contacting with each other at the interface between the heavy (H) chain constant domains can include a residue at EU numbering position 356, a residue at EU numbering position 439, a residue at EU numbering position 357, a residue at EU numbering position 370, a residue at EU numbering position 399, and a residue at EU numbering position 409 in one CH3 domain, and their partner residues in another CH3 domain.

More specifically, for example, an antigen-binding molecule comprising two heavy (H) chain CH3 domains can be prepared as an antigen-binding molecule in which one to three pairs of amino acid residues selected from the following amino acid residue pairs (1) to (3) in the first H chain CH3 domain carry the same electric charge; (1) amino acid residues at EU numbering positions 356 and 439 contained in the H chain CH3 domain; (2) amino acid residues at EU numbering positions 357 and 370 contained in the H chain CH3 domain; and (3) amino acid residues at EU numbering positions 399 and 409 contained in the H chain CH3 domain.

The antigen-binding molecule can be further prepared as an antigen-binding molecule in which one to three pairs of amino acid residues are selected from the amino acid residue pairs (1) to (3) in the second H chain CH3 domain different from the first H chain CH3 domain so as to correspond to the amino acid residue pairs (1) to (3) carrying the same electric charge in the first H chain CH3 domain and to carry opposite electric charge from their corresponding amino acid residues in the first H chain CH3 domain.

Each amino acid residue described in the pairs (1) to (3) is located close to its partner in the associated H chains. Those skilled in the art can find positions corresponding to the amino acid residues described in each of the pairs (1) to (3) as to the desired H chain CH3 domains or H chain constant domains by homology modeling or the like using commercially available software and can appropriately alter amino acid residues at the positions.

In the antigen-binding molecule described above, each of the "amino acid residues carrying electric charge" is preferably selected from, for example, amino acid residues included in any of the following groups (a) and (b);

(a) glutamic acid (E) and aspartic acid (D); and (b) lysine (K), arginine (R), and histidine (H).

In the antigen-binding molecule described above, the phrase "carrying the same electric charge" means that, for example, all of two or more amino acid residues are amino acid residues included in any one of the groups (a) and (b). The phrase "carrying opposite electric charge" means that, for example, at least one amino acid residue among two or more amino acid residues may be an amino acid residue included in any one of the groups (a) and (b), while the remaining amino acid residue(s) is amino acid residue(s) included in the other group.

In a preferred embodiment, the antigen-binding molecule may have the first H chain CH3 domain and the second H chain CH3 domain cross-linked through a disulfide bond. As described above, the amino acid residue to be altered according to the present invention is not limited to the amino acid residues in the antibody variable region or the antibody constant region mentioned above. Those skilled in the art can find amino acid residues constituting the interface as to a polypeptide variant or a heteromultimer by homology modeling or the like using commercially available software and can alter amino acid residues at the positions so as to regulate the association.

The association for the multispecific antigen-binding molecule of the present invention can also be carried out by an alternative technique known in the art. An amino acid side chain present in a heavy chain variable (VH) region is substituted by a larger side chain (knob), and its partner amino acid side chain present in other heavy chain variable (VH) region is substituted by a smaller side chain (hole). The knob can be placed into the hole to efficiently associate the polypeptides of the Fc domains differing in amino acid sequence (WO1996/027011; Ridgway J B et al., Protein Engineering (1996) 9, 617-621; and Merchant A M et al. Nature Biotechnology (1998) 16, 677-681).

In addition to this technique, a further alternative technique known in the art may be used for forming the multispecific antigen-binding molecule of the present invention. A portion of CH3 of one heavy (H) chain is converted to its counterpart IgA-derived sequence, and its complementary portion in CH3 of the other heavy (H) chain is converted to its counterpart IgA-derived sequence. Use of the resulting strand-exchange engineered domain CH3 can cause efficient association between the polypeptides differing in sequence through complementary CH3 association (Protein Engineering Design & Selection, 23; 195-202, 2010). By use of this technique known in the art, the multispecific antigen-binding molecule of interest can also be efficiently formed.

Alternatively, the multispecific antigen-binding molecule may be formed by, for example, an antibody preparation technique using antibody CH1-CL association and VH-VL association as described in WO2011/028952, a technique of preparing a bispecific antibody using separately prepared monoclonal antibodies (Fab arm exchange) as described in WO2008/119353 and WO2011/131746, a technique of controlling the association between antibody heavy chain CH3 domains as described in WO2012/058768 and WO2013/063702, a technique of preparing a bispecific antibody constituted by two types of light chains and one type of heavy chain as described in WO2012/023053, or a technique of preparing a bispecific antibody using two bacterial cell lines each expressing an antibody half-molecule consisting of one H chain and one L chain as described in Christoph et al. (Nature Biotechnology Vol. 31, p. 753-758 (2013)). In addition to these association techniques, CrossMab technology, a known hetero light chain association technique of associating a light chain forming a variable region binding to a first epitope and a light chain forming a variable region binding to a second epitope to a heavy chain forming the variable region binding to the first epitope and a heavy chain forming the variable region binding to the second epitope, respectively (Scaefer et al., Proc. Natl. Acad. Sci. U.S.A. (2011) 108, 11187-11192), can also be used for preparing a multispecific or multiparatopic antigen-binding molecule provided by the present invention.

Examples of the technique of preparing a bispecific antibody using separately prepared monoclonal antibodies can include a method which involves promoting antibody heterodimerization by placing monoclonal antibodies with a particular amino acid substituted in a heavy chain CH3 domain under reductive conditions to obtain the desired bispecific antibody. Examples of the amino acid substitution site preferred for this method can include a residue at EU numbering position 392 and a residue at EU numbering position 397 in the CH3 domain. Furthermore, the bispecific antigen-binding molecule can also be prepared by use of an antibody in which one to three pairs of amino acid residues selected from the following amino acid residue pairs (1) to (3) in the first H chain CH3 domain carry the same electric charge: (1) amino acid residues at EU numbering positions 356 and 439 contained in the H chain CH3 domain; (2) amino acid residues at EU numbering positions 357 and 370 contained in the H chain CH3 domain; and (3) amino acid residues at EU numbering positions 399 and 409 contained in the H chain CH3 domain. The bispecific antigen-binding molecule can also be prepared by use of the antibody in which one to three pairs of amino acid residues are selected from the amino acid residue pairs (1) to (3) in the second H chain CH3 domain different from the first H chain CH3 domain so as to correspond to the amino acid residue pairs (1) to (3) carrying the same electric charge in the first H chain CH3 domain and to carry opposite electric charge from their corresponding amino acid residues in the first H chain CH3 domain.

Even if the multispecific antigen-binding molecule of interest cannot be formed efficiently, the multispecific antigen-binding molecule of the present invention may be obtained by the separation and purification of the multispecific antigen-binding molecule of interest from among produced antigen-binding molecules. For example, the previously reported method involves introducing amino acid substitution to the variable domains of two types of H chains to impart thereto difference in isoelectric point so that two types of homodimers and the heterodimerized antibody of interest can be separately purified by ion-exchanged chromatography (WO2007114325). A method using protein A to purify a heterodimerized antibody consisting of a mouse IgG2a H chain capable of binding to protein A and a rat IgG2b H chain incapable of binding to protein A has previously been reported as a method for purifying the heterodimer (WO98050431 and WO95033844). Alternatively, amino acid residues at EU numbering positions 435 and 436 that constitute the protein A-binding site of IgG may be substituted by amino acids, such as Tyr and His, which offer the different strength of protein A binding, and the resulting H chain is used to change the interaction of each H chain with protein A. As a result, only the heterodimerized antibody can be efficiently purified by use of a protein A column.

A plurality of, for example, two or more of these techniques may be used in combination. Also, these techniques can be appropriately applied separately to the two heavy (H) chains to be associated. On the basis of, but separately from the form thus altered, the antigen-binding molecule of the present invention may be prepared as an antigen-binding molecule having an amino acid sequence identical thereto.

The alteration of an amino acid sequence can be performed by various methods known in the art. Examples of these methods that may be performed can include, but are not limited to, methods such as site-directed mutagenesis (Hashimoto-Gotoh. T, Mizuno. T, Ogasahara. Y, and Nakagawa. M (1995) An oligodeoxyribonucleotide-directed dual amber method for site-directed mutagenesis. Gene 152, 271-275. Zoller, M J, and Smith, M. (1983) Oligonucleotide-directed mutagenesis of DNA fragments cloned into M13 vectors. Methods Enzymol. 100, 468-500; Kramer, W. Drutsa, V, Jansen, H W. Kramer, B, Pflugfelder. M, and Fritz, H J (1984) The gapped duplex DNA approach to oligonucleotide-directed mutation construction. Nucleic Acids Res. 12, 9441-9456; Kramer W, and Fritz H J (1987) Oligonucleotide-directed construction of mutations via gapped duplex DNA Methods. Enzymol. 154, 350-367; and Kunkel, T A (1985) Rapid and efficient site-specific mutagenesis without phenotypic selection. Proc Natl Acad Sci USA. 82, 488-492), PCR mutagenesis, and cassette mutagenesis.

The antigen-binding molecule of the present invention can further contain additional alteration in addition to the amino acid alteration mentioned above. The additional alteration can be selected from, for example, amino acid substitution, deletion, and modification, and a combination thereof.

For example, the antigen-binding molecule of the present invention can be further altered arbitrarily, substantially without changing the intended functions of the molecule. Such a mutation can be performed, for example, by the conservative substitution of amino acid residues. Alternatively, even alteration to change the intended functions of the antigen-binding molecule of the present invention may be carried out as long as the functions changed by such alteration fall within the object of the present invention.

The alteration of an amino acid sequence according to the present invention also includes posttranslational modification. Specifically, the posttranslational modification can refer to the addition or deletion of a sugar chain. The antigen-binding molecule of the present invention, for example, having an IgG1-type constant region, can have a sugar chain-modified amino acid residue at EU numbering position 297. The sugar chain structure for use in the modification is not limited. In general, antibodies expressed by eukaryotic cells involve sugar chain modification in their constant regions. Thus, antibodies expressed by the following cells are usually modified with some sugar chain;

mammalian antibody-producing cells; and eukaryotic cells transformed with expression vectors comprising antibody-encoding DNAs.

In this context, the eukaryotic cells include yeast and animal cells. For example, CHO cells or HEK293H cells are typical animal cells for transformation with expression vectors comprising antibody-encoding DNAs. On the other hand, the antibody of the present invention also includes antibodies lacking sugar chain modification at the position. The antibodies having sugar chain-unmodified constant regions can be obtained by the expression of genes encoding these antibodies in prokaryotic cells such as *E. coli.*

The additional alteration according to the present invention may be more specifically, for example, the addition of sialic acid to a sugar chain in an Fc region (mAbs. 2010 September-October; 2 (5): 519-27).

When the antigen-binding molecule of the present invention has an Fc region, for example, amino acid substitution to improve binding activity against FcRn (J Immunol. 2006 Jan. 1:176 (1): 346-56; J Biol Chem. 2006 Aug. 18:281 (33): 23514-24; Int Immunol. 2006 December; 18 (12): 1759-69; Nat Biotechnol. 2010 February; 28 (2): 157-9; WO2006/019447; WO2006/053301; and WO2009/086320) or amino acid substitution to improve antibody heterogeneity or stability ((WO2009/041613)) may be added thereto.

If the term "antibody" is used in the instant application, it is construed in the broadest sense and also includes any antibody such as monoclonal antibodies (including whole monoclonal antibodies), polyclonal antibodies, antibody variants, antibody fragments, multispecific antibodies (e.g., bispecific antibodies), chimeric antibodies, and humanized antibodies as long as the antibody exhibits the desired biological activity.

If the term "antibody" is used in the instant application, it is not limited by the type of its antigen, its origin, etc., and may be any antibody. Examples of the origin of the antibody can include, but are not particularly limited to, human antibodies, mouse antibodies, rat antibodies, and rabbit antibodies.

The antibody can be prepared by a method well known to those skilled in the art. For example, the monoclonal antibodies may be produced by a hybridoma method (Kohler and Milstein. Nature 256:495 (1975)) or a recombination method (U.S. Pat. No. 4,816,567). Alternatively, the monoclonal antibodies may be isolated from phage-displayed antibody libraries (Clackson et al., Nature 352:624-628 (1991); and Marks et al., J. Mol. Biol. 222: 581-597 (1991)). Also, the monoclonal antibodies may be isolated from single B cell clones (N. Biotechnol. 28 (5): 253-457 (2011)).

The humanized antibodies are also called reshaped human antibodies. Specifically, for example, a humanized antibody consisting of a non-human animal (e.g., mouse) antibody CDR-grafted human antibody is known in the art. General gene recombination approaches are also known for obtaining the humanized antibodies. Specifically, for example, overlap extension PCR is known in the art as a method for grafting mouse antibody CDRs to human FRs.

DNAs encoding antibody variable domains each comprising three CDRs and four FRs linked and DNAs encoding human antibody constant domains can be inserted into expression vectors such that the variable domain DNAs are fused in frame with the constant domain DNAs to prepare vectors for humanized antibody expression. These vectors having the inserts are transferred to hosts to establish recombinant cells. Then, the recombinant cells are cultured for the expression of the DNAs encoding the humanized antibodies to produce the humanized antibodies into the cultures of the cultured cells (see European Patent Publication No. EP 239400 and International Publication No. WO1996/002576).

If necessary. FR amino acid residue(s) may be substituted such that the CDRs of the reshaped human antibody form an appropriate antigen-binding site. For example, the amino acid sequence of FR can be mutated by the application of the PCR method used in the mouse CDR grafting to the human FRs.

The desired human antibody can be obtained by DNA immunization using transgenic animals having all repertoires of human antibody genes (see International Publication Nos. WO1993/012227, WO1992/003918, WO 1994/002602. WO1994/025585, WO1996/034096, and WO1996/033735) as immunized animals.

In addition, a technique of obtaining human antibodies by panning using human antibody libraries is also known. For example, a human antibody V region is expressed as a single-chain antibody (scFv) on the surface of phages by a phage display method. A phage expressing antigen-binding scFv can be selected. The gene of the selected phage can be analyzed to determine a DNA sequence encoding the V region of the antigen-binding human antibody. After the determination of the DNA sequence of the antigen-binding scFv, the V region sequence can be fused in frame with the sequence of the desired human antibody C region and then inserted to appropriate expression vectors to prepare expression vectors. The expression vectors are transferred to the preferred expression cells listed above for the expression of the genes encoding the human antibodies to obtain the human antibodies. These methods are already known in the art (see International Publication Nos. WO1992/001047, WO1992/020791, WO1993/006213. WO1993/011236, WO1993/019172, WO1995/001438, and WO1995/015388).

In addition to the phage display technique, for example, a technique using a cell-free translation system, a technique of displaying an antigen-binding molecule on the surface of a cell or a virus, and a technique using an emulsion are known as techniques for obtaining a human antibody by panning using a human antibody library. For example, a ribosome display method which involves forming a complex of mRNA and a translated protein via a ribosome by the removal of a stop codon, etc., a cDNA or mRNA display method which involves covalently binding a translated protein to a gene sequence using a compound such as puromycin, or a CIS display method which involves forming a complex of a gene and a translated protein using a nucleic acid-binding protein, can be used as the technique using a cell-free translation system. The phage display method as well as an *E. coli* display method, a gram-positive bacterium display method, a yeast display method, a mammalian cell display method, a virus display method, or the like can be used as the technique of displaying an antigen-binding molecule on the surface of a cell or a virus. For example, an in vitro virus display method using a gene and a translation-related molecule enclosed in an emulsion can be used as the technique using an emulsion. These methods have already been known in the art (Nat Biotechnol. 2000 December; 18 (12): 1287-92; Nucleic Acids Res. 2006:34 (19): e127; Proc Natl Acad Sci USA. 2004 Mar. 2:101 (9): 2806-10; Proc Natl Acad Sci USA. 2004 Jun. 22:101 (25): 9193-8; Protein Eng Des Sel 2008 April; 21 (4): 247-55; Proc Natl Acad Sci USA. 2000 Sep. 26:97 (20): 10701-5; MAbs. 2010 September-October; 2 (5): 508-18; and Methods Mol Biol. 2012; 911: 183-98).

One of the variable regions of the antibody included in each antigen-binding domain of the antigen-binding molecule of the present invention is capable of binding to two different antigens, but cannot bind to these antigens at the same time. In some embodiment, one of the variable regions of the antibody included in each antigen-binding domain of the antigen-binding molecule of the present invention is capable of binding to the first antigen, but does not bind to the second antigen.

The "first antigen" or the "second antigen" to which a first antigen-binding domain and/or a second antigen-binding domain binds is preferably, for example, an immunocyte surface molecule (e.g., a T cell surface molecule, an NK cell surface molecule, a dendritic cell surface molecule, a B cell surface molecule, an NKT cell surface molecule, an MDSC cell surface molecule, and a macrophage surface molecule), or an antigen expressed not only on tumor cells, tumor vessels, stromal cells, and the like but on normal tissues (integrin, tissue factor, VEGFR, PDGFR, EGFR, IGFR, MET chemokine receptor, heparan sulfate proteoglycan, CD44, fibronectin, DR5, TNFRSF, etc.).

As for the combination of the "first antigen" and the "second antigen", preferably, any one of the first antigen and the second antigen is, for example, a molecule specifically expressed on a T cell, and the other antigen is a molecule expressed on the surface of a T cell or any other immunocyte. In another embodiment of the combination of the "first antigen" and the "second antigen", preferably, any one of the first antigen and the second antigen is, for example, a molecule specifically expressed on a T cell, and the other antigen is a molecule that is expressed on an immunocyte and is different from the preliminarily selected antigen.

Specific examples of the molecule specifically expressed on a T cell include CD3 and T cell receptors. Particularly. CD3 is preferred. In the case of, for example, human CD3, a site in the CD3 to which the antigen-binding molecule of the present invention binds may be any epitope present in a gamma chain, delta chain, or epsilon chain sequence constituting the human CD3. Particularly, an epitope present in the extracellular region of an epsilon chain in a human CD3 complex is preferred. The polynucleotide sequences of the gamma chain, delta chain, and epsilon chain structures constituting CD3 are NM_000073.2. NM_000732.4, and NM_000733.3, and the polypeptide sequences thereof are NP_000064.1. NP_000723.1, and NP_000724.1 (RefSeq registration numbers). Examples of the other antigen include Fc gamma receptors, TLR, lectin. IgA, immune checkpoint molecules, TNF superfamily molecules, TNFR superfamily molecules, and NK receptor molecules.

In one embodiment, the first antigen is a molecule specifically expressed on a T cell, preferably a T cell receptor complex molecule such as CD3, more preferably human CD3. In another embodiment, the second antigen is a molecule expressed on a T cell or any other immune cell, preferably a cell surface modulator on an immune cell, more preferably a costimulatory molecule expressed on a T cell, and even more preferably a protein of "TNF superfamily" or the "TNF receptor superfamily" including not limited to human CD137 (4-1BB), CD137L, CD40, CD40L, OX40, OX40L, CD27, CD70, HVEM, LIGHT, RANK, RANKL, CD30, CD153, GITR, and GITRL. In one preferred embodiment, the first antigen is CD3 and the second antigen is CD137. Here, the first antigen and the second antigen are defined interchangeably.

The term "CD137" herein, also called 4-1BB, is a member of the tumor necrosis factor (TNF) receptor family. Examples of factors belonging to the TNF superfamily or the TNF receptor superfamily include CD137, CD137L, CD40, CD40L, OX40, OX40L, CD27, CD70, HVEM, LIGHT, RANK, RANKL, CD30, CD153, GITR, and GITRL.

In some embodiments of the present invention, the antigen-binding molecule of the present invention further comprises a third antigen-binding domain which binds to a "third antigen" that is different from the "first antigen" and the "second antigen" mentioned above. The third antigen-binding domain binding to a third antigen of the present invention can be an antigen-binding domain that recognizes an arbitrary antigen. The third antigen-binding domain binding to a third antigen of the present invention can be an antigen-binding domain that recognizes a molecule specifically expressed in a cancer tissue.

In the present specification, the "third antigen" is not particularly limited and may be any antigen. Examples of the antigen include 17-IA, 4Dc, 6-keto-PGF1a, 8-iso-PGF2a, 8-oxo-dG, A1 Adenosine Receptor, A33, ACE, ACE-2, Activin, Activin A, Activin AB. Activin B, Activin C, Activin RIA, Activin RIA ALK-2. Activin RIB ALK-4, Activin RIIA. Activin RIIB. ADAM, ADAM10, ADAM12, ADAM15, ADAM17/TACE, ADAM8, ADAM9, ADAMTS, ADAMTS4, ADAMTS5, Addressins, adiponectin, ADP ribosyl cyclase-1, aFGF. AGE, ALCAM, ALK. ALK-1. ALK-7, allergen, alpha1-antichemotrypsin, alpha1-antitrypsin, alpha-synuclein, alpha-V/beta-1 antagonist, aminin, amylin, amyloid beta, amyloid immunoglobulin heavy chain variable region, amyloid immunoglobulin light chain variable region, Androgen, ANG, angiotensinogen, Angiopoietin ligand-2, anti-Id, antithrombinIII, Anthrax, APAF-1, APE, APJ, apo A1, apo serum amyloid A, Apo-SAA, APP, APRIL, AR, ARC, ART, Artemin, ASPARTIC, Atrial natriuretic factor. Atrial natriuretic peptide, atrial natriuretic peptides A, atrial natriuretic peptides B, atrial natriuretic peptides C, av/b3 integrin, Axl, B7-1. B7-2, B7-H. BACE, BACE-1, *Bacillus anthracis* protective antigen, Bad. BAFF, BAFF-R. Bag-1, BAK, Bax, BCA-1, BCAM, Bcl, BCMA, BDNF, b-ECGF, beta-2-microglobulin, beta1actamase, bFGF, BID, Bik, BIM, BLC, BL-CAM, BLK, B-lymphocyte Stimulator (BlyS), BMP, BMP-2 (BMP-2a), BMP-3 (Osteogenin), BMP-4 (BMP-2b), BMP-5, BMP-6 (Vgr-1), BMP-7 (OP-1), BMP-8 (BMP-8a), BMPR, BMPR-IA (ALK-3), BMPR-IB (ALK-6), BMPR-II (BRK-3). BMPs, BOK, Bombesin, Bone-derived neurotrophic factor, bovine growth hormone, BPDE, BPDE-DNA, BRK-2, BTC, B-lymphocyte cell adhesion molecule, C10, C1-inhibitor, C1q, C3, C3a, C4, C5, CSa (complement 5a), CA125, CAD-8, Cadherin-3, Calcitonin, CAMP, Carbonic anhydrase-IX, carcinoembryonic antigen (CEA), carcinoma-associated antigen, Cardiotrophin-1, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1/1-309, CCL11/Eotaxin, CCL12/MCP-5, CCL13/MCP-4, CCL14/HCC-1, CCL15/HCC-2, CCL16/HCC-4, CCL17/TARC, CCL18/PARC, CCL19/ELC, CCL2/MCP-1, CCL20/MIP-3-alpha, CCL21/SLC, CCL22/MDC, CCL23/MPIF-J, CCL24/Eotaxin-2, CCL25/TECK, CCL26/Eotaxin-3, CCL27/CTACK, CCL28/MEC, CCL3/MIP-1-alpha, CCL3L1/LD-78-beta, CCL4/MIP-1-beta, CCL5/RANTES, CCL6/C10, CCL7/MCP-3, CCL8/MCP-2, CCL9/10/MTP-1-gamma, CCR, CCR1, CCR10, CCR2, CCR3, CCR4, CCR5, CCR6, CCR7, CCR8, CCR9, CD1, CD10, CD105, CD11a, CD11b, CD11c, CD123, CD13, CD137, CD138, CD14, CD140a, CD146, CD147, CD148, CDIS, CDIS2, CD16, CD164, CD18, CD19, CD2, CD20, CD21, CD22, CD23, CD25, CD26, CD27L, CD28, CD29, CD3, CD30, CD30L, CD32, CD33 (p67 proteins), CD34, CD37, CD38, CD3E, CD4, CD40, CD40L, CD44, CD45, CD46, CD49a, CD49b, CD5, CDS1, CD52, CD54, CD55, CD56, CD6, CD61, CD64, CD66e, CD7, CD70, CD74, CD8, CD80 (B7-1), CD89, CD95, CD105, CD158a, CEA, CEACAM5, CFTR, cGMP, CGRP receptor, CINC, CKb8-1, Claudin 18, CLC. *Clostridium botulinum* toxin, *Clostridium difficile* toxin, *Clostridium perfringens* toxin, c-Met, CMV, CMV UL, CNTF, CNTN-1, complement factor 3 (C3), complement factor D, corticosteroid-binding globulin, Colony stimulating factor-1 receptor, COX, C-Ret, CRG-2, CRTH2, CT-1, CTACK, CTGF, CTLA-4, CX3CL 1/Fractalkine, CX3CR1, CXCL, CXCL1/Gro-alpha, CXCL10, CXCL1I/I-TAC, CXCL12/SDF-1-alpha/beta, CXCL 13/BCA-1, CXCL14/BRAK, CXCL 15/Lungkine, CXCL16, CXCL16, CXCL2/Gro-beta CXCL3/Gro-gamma, CXCL3, CXCL4/PF4, CXCL5/ENA-78, CXCL6/GCP-2, CXCL7/NAP-2, CXCL8/IL-8, CXCL9/Mig, CXCL1O/IP-10, CXCR, CXCR1, CXCR2, CXCR3, CXCR4, CXCR5, CXCR6, cystatin C, cytokeratin tumor-associated antigen, DAN, DCC, DcR3, DC-SIGN, Decay accelerating factor, Delta-like protein ligand 4, des (1-3)-IGF-1 (brain IGF-1), Dhh, DHICA oxidase, Dickkopf-1, digoxin, Dipeptidyl peptidase IV, DKI, DNAM-1, Dnase, Dpp, DPPIV/CD26, Dtk, ECAD, EDA, EDA-A1, EDA-A2, EDAR, EGF, EGFR (ErbB-1), EGF like domain containing protein 7, Elastase, elastin, EMA, EMMPRIN, ENA, ENA-78, Endosialin, endothelin receptor, endotoxin, Enkephalinase, eNOS, Eot, Eotaxin, Eotaxin-2, eotaxini, EpCAM, Ephrin B2/EphB4, Epha2 tyrosine kinase receptor, epidermal growth factor receptor (EGFR), ErbB2 receptor, ErbB3 tyrosine kinase receptor, ERCC, EREG, erythropoietin (EPO), Erythropoietin receptor, E-selectin, ET-1, Exodus-2, F protein of RSV, F10, F11, F12, F13, F5, F9, Factor Ia, Factor IX, Factor Xa, Factor VII, factor VIII, Factor VIIIc, Fas, FcalphaR, FcepsilonRI, FcgammaIIb, FcgammaRI, FcgammaRIIa, FcgammaRIIIa, FcgammaRIIIb, FcRn, FEN-1, Ferritin, FGF, FGF-19, FGF-2, FGF-2 receptor, FGF-3, FGF-8, FGF-acidic, FGF-basic, Fibrin, fibroblast activation protein (FAP), fibroblast growth factor, fibroblast growth factor-10, fibronectin, FL, FLIP, Flt-3, FLT3 ligand, Folate receptor, follicle stimulating hormone (FSH), Fractalkine (CX3C), free heavy chain, free light chain, FZD1, FZD10, FZD2, FZD3, FZD4, FZD5, FZD6, FZD7, FZD8, FZD9, G250, Gas 6, GCP-2, GCSF, G-CSF, G-CSF receptor, GD2, GD3, GDF, GDF-1, GDF-15 (MIC-1), GDF-3 (Vgr-2), GDF-5 (BMP-14/CDMP-1), GDF-6 (BMP-13/CDMP-2), GDF-7 (BMP-12/CDMP-3), GDF-8 (Myostatin), GDF-9, GDNF, Gelsolin, GFAP, GF-CSF, GFR-alpha1, GFR-alpha2, GFR-alpha3, GF-beta 1, gH envelope glycoprotein, GITR, Glucagon, Glucagon receptor, Glucagon-like peptide I receptor, Glut 4, Glutamate carboxypeptidase II, glycoprotein hormone receptors, glycoprotein IIb/IIIa (GP IIb/IIIa), Gly pican-3, GM-CSF, GM-CSF receptor, gp130, gp140, gp72, granulocyte-CSF (G-CSF), GRO/MGSA, Growth hormone releasing factor, GRO-beta, GRO-gamma, *H. pylori*, Hapten (NP-cap or NIP-cap), HB-EGF, HCC, HCC 1, HCMV gB envelope glycoprotein, HCMV UL, Hemopoietic growth factor (HGF), Hep B gp120, heparanase, heparin cofactor II, hepatic growth factor, *Bacillus anthracis* protective antigen, Hepatitis C virus E2 glycoprotein, Hepatitis E, Hepcidin, Her1, Her2/neu (ErbB-2), Her3 (ErbB-3), Her4 (ErbB-4), herpes simplex virus (HSV) gB glycoprotein, HGF, HGFA, High molecular weight melanoma-associated antigen (HMW-MAA), HIV envelope proteins such as GP 120, HIV MIB gp 120 V3 loop, HLA, HLA-DR, HM1,24, HMFG PEM, HMGB-1, HRG, Hrk, HSP47, Hsp90, HSV gD glycoprotein, human cardiac myosin, human cytomegalovirus (HCMV), human growth hormone (hGH), human serum albumin, human tissue-type plasminogen activator (t-PA), Huntingtin, HVEM, IAP, ICAM, ICAM-1, ICAM-3, ICE, ICOS, IFN-alpha, IFN-beta, IFN-gamma, IgA, IgA receptor, IgE, IGF, IGF binding proteins, IGF-1, IGF-1R, IGF-2, IGFBP, IGFR, IL, IL-1, IL-10, IL-10 receptors, IL-11, IL-11 receptors, IL-12, IL-12 receptors, IL-13, IL-13 receptors, IL-15, IL-15 receptors, IL-16, IL-16 receptors, IL-17, IL-17 receptors, IL-18 (IGIF), IL-18 receptors, IL-1alpha, IL-1beta, IL-1 receptors, IL-2, IL-2 receptors, IL-20, IL-20 receptors, IL-21, IL-21 receptors, IL-23, IL-23 receptors, IL-2 receptors, IL-3, IL-3 receptors, IL-31, IL-31 receptors, IL-3 receptors, IL-4, IL-4 receptors IL-5, IL-5 receptors, IL-6, IL-6 receptors, IL-7, IL-7 receptors, IL-8, IL-8 receptors, IL-9, IL-9 receptors, immunoglobulin immune complex, immunoglobulins, INF-alpha, INF-alpha receptors, INF-beta, INF-beta receptors, INF-gamma, INF-gamma receptors, IFN type-I, IFN type-I receptor, influenza, inhibin, Inhibin alpha, Inhibin beta, iNOS, insulin, Insulin A-chain, Insulin B-chain, Insulin-like growth factor 1, insulin-like growth factor 2, insulin-like growth factor binding proteins, integrin, integrin alpha2, integrin alpha3, integrin alpha4, integrin alpha4/beta1, integrin alpha-V/beta-3, integrin alpha-V/beta-6, integrin alpha4/beta7, integrin alpha5/beta1, integrin alpha5/beta3, integrin alpha5/beta6, integrin alpha sigma (alphaV), integrin alpha theta, integrin beta1, integrin beta2, integrin beta3 (GPllb-Illa), IP-10, I-TAC, JE, kalliklein, Kallikrein 11, Kallikrein 12, Kallikrein 14, Kallikrein 15, Kallikrein 2, Kallikrein S, Kallikrein 6, Kallikrein L1, Kallikrein L2, Kallikrein L3, Kallikrein L4, kallistatin, KC, KDR, Keratinocyte Growth Factor (KGF), Keratinocyte Growth Factor-2 (KGF-2), KGF, killer immunoglobulin-like receptor, kit ligand (KL), Kit tyrosine kinase, laminin 5, LAMP, LAPP (Amylin, islet-amyloid polypeptide), LAP (TGF-1), latency associated peptide, Latent TGF-1, Latent TGF-1 bp1, LBP, LDGF, LDL, LDL receptor, LECT2, Lefty, Leptin, leutinizing hormone (LH), Lewis-Y antigen, Lewis-Y related antigen, LFA-1, LFA-3, LFA-3 receptors, Lfo, LIF, LIGHT, lipoproteins, LIX, LKN, Lptn, L-Selectin, LT-a, LT-b, LTB4, LTBP-1, Lung surfactant, Luteinizing hormone, Lymphotactin, Lymphotoxin Beta Receptor, Lysosphingolipid receptor, Mac-1, macrophage-CSF (M-CSF), MAdCAM, MAG, MAP2, MARC, maspin, MCAM, MCK-2, MCP, MCP-1, MCP-2, MCP-3, MCP-4, MCP-1 (MCAF), M-CSF, MDC, MDC (67 a.a.), MDC (69 a.a.), megsin, Mer, MET tyrosine kinase receptor family, METALLOPROTEASES, Membrane glycoprotein OX2, Mesothelin, MGDF receptor, MGMT, MHC (HLA-DR), microbial protein, MIF, MIG, MIP, MIP-1 alpha, MIP-1 beta, MIP-3 alpha, MIP-3 beta, MIP-4, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, monocyte attractant protein, monocyte colony inhibitory factor, mouse gonadotropin-associated peptide, MPIF, Mpo, MSK, MSP, MUC-16, MUCI8, mucin (Mud), Muellerian-inhibiting substance, Mug, MuSK, Myelin associated glycoprotein, myeloid progenitor inhibitor factor-1 (MPIF-1), NAIP, Nanobody, NAP, NAP-2, NCA 90, NCAD, N-Cadherin, NCAM, Neprily sin, Neural cell adhesion molecule, neroserpin, Neuronal growth factor (NGF), Neurotrophin-3, Neurotrophin-4, Neurotrophin-6, Neuropilin 1, Neurturin, NGF-beta, NGFR, NKG20, N-methionyl human growth hormone, nNOS, NO, Nogo-A, Nogo receptor, non-structural protein type 3 (NS3) from the hepatitis C virus, NOS, Npn, NRG-3, NT, NT-3, NT-4, NTN, OB, OGG1, Oncostatin M, OP-2, OPG, OPN, OSM, OSM receptors, osteoinductive factors, osteopontin, OX40L, OX40R, oxidized LDL, p150, p95, PADPr, parathyroid hormone, PARC, PARP, PBR, PBSF, PCAD, P-Cadherin, PCNA, PCSK9, PDGF, PDGF receptor, PDGF-AA, PDGF-AB, PDGF-BB, PDGF-D, PDK-1, PECAM, PEDF, PEM, PF-4, PGE, PGF, PGI2, PGJ2, PIGF, PIN, PLA2, Placenta growth factor, placental alkaline phosphatase (PLAP), placental lactogen, plasminogen activator inhibitor-1, platelet-growth factor, plgR, PLP, poly glycol chains of different size (e.g., PEG-20, PEG-30, PEG40), PP14, prekallikrein, prion protein, procalcitonin, Programmed cell death protein 1, proinsulin, prolactin, Proprotein convertase PC9, prorelaxin, prostate specific membrane antigen (PSMA), Protein A, Protein C, Protein D, Protein S, Protein Z, PS, PSA, PSCA, PsmAr, PTEN, PTHrp, Ptk, PTN, P-selectin glycoprotein ligand-1, R51, RAGE, RANK, RANKL, RANTES, relaxin, Relaxin A-chain, Relaxin B-chain, renin, respiratory syncytial virus (RSV) F, Ret, reticulon 4, Rheumatoid factors, RLI P76, RPA2, RPK-1, RSK, RSV Fgp, S100, RON-8, SCF/KL, SCGF, Sclerostin, SDF-1, SDF1 alpha, SDF1 beta, SERINE, Serum Amyloid P, Serum albumin, sFRP-3, Shh, Shiga like toxin II, SIGIRR, SK-1, SLAM, SLPI, SMAC, SMDF, SMOH, SOD, SPARC, sphingosine 1-phosphate receptor 1, Staphylococcal lipoteichoic acid, Stat, STEAP, STEAP-II, stem cell factor (SCF), streptokinase, superoxide dismutase, syndecan-1, TACE, TACI, TAG-72 (tumor-associated glycoprotein-72), TARC, TB, TCA-3, T-cell receptor alpha/beta, TdT, TECK, TEMI, TEM5, TEM7, TEM8, Tenascin, TERT, testicular PLAP-like alkaline phosphatase, TfR, TGF, TGF-alpha, TGF-beta, TGF-beta Pan Specific, TGF-beta RII, TGF-beta RIIb, TGF-beta RIII, TGF-beta R1 (ALK-5), TGF-beta1, TGF-beta2, TGF-beta3, TGF-beta4, TGF-beta5, TGF-1, Thrombin, thrombopoietin (TPO), Thymic stromal lymphoprotein receptor, Thymus Ck-1, thyroid stimulating hormone (TSH), thyroxine, thyroxine-binding globulin, Tie, TIMP, TIQ, Tissue Factor, tissue factor protease inhibitor, tissue factor protein, TMEFF2, Tmpo, TMPRSS2, TNF receptor I, INF receptor II, TNF-alpha, TNF-beta, TNF-beta2, TNFc, TNF-RI, TNF-RII, TNFRSF10A (TRAIL R1 Apo-2/DR4), TNFRSF10B (TRAIL R2 DR5/KILLER/TRICK-2A/TRICK-B), TNFRSF10C (TRAIL R3 DcR1/LIT/TRID), TNFRSF10D (TRAIL R4 DcR2/TRUNDD), TNFRSF11A (RANK ODF R/TRANCE R), TNFRSF11B (OPG OCIF/TR1), TNFRSF12 (TWEAK R FN14), TNFRSF12A, TNFRSF13B (TACI), TNFRSF13C (BAFF R), TNFRSF14 (HVEM ATAR/HveA/LIGHT R/TR2), TNFRSF16 (NGFR p75NTR), TNFRSF17 (BCMA), TNFRSF18 (GITR AITR), TNFRSF19 (TROY TAJ/TRADE), TNFRSF19L (RELT), TNFRSF1A (TNF R1 CD120a/p55-60), TNFRSF1B (TNF RII CD120b/p75-80), TNFRSF21 (DR6), TNFRSF22 (Dc-TRAIL R2 TNFRH2), TNFRSF25 (DR3 Apo-3/LARD/TR-3/TRAMP/WSL-1), TNFRSF26 (TNFRH3), TNFRSF3 (LTbR TNF RIII/TNFC R), TNFRSF4 (OX40 ACT35/TXGP1R), TNFRSF5 (CD40 p50), TNFRSF6 (Fas Apo-1/APT1/CD95), TNFRSF6B (DcR3 M68/TR6), TNFRSF7 (CD27), TNFRSF8 (CD30), TNFRSF9 (4-1 BB CD137/ILA), TNFRST23 (DcTRAIL R1 TNFRH1), TNFSF10 (TRAIL Apo-2 Ligand/TL2), TNFSF11 (TRANCE/RANK Ligand ODF/OPG Ligand), TNFSF12 (TWEAK Apo-3 Ligand/DR3 Ligand), TNFSF13 (APRIL TALL2), TNFSF13B (BAFF BLYS/TALL1/THANK/TNFSF20), TNFSF14 (LIGHT HVEM Ligand/LTg), TNFSF15 (TL1A/VEG1), TNFSF18 (GITR Ligand AITR Ligand/TL6), TNFSF1A (TNF-α Conectin/DIF/TNFSF2), TNFSF1B (TNF-b LTa/TNFSF1), TNFSF3 (LTb TNFC/p33), TNFSF4 (OX40 Ligand gp34/TXGP1), TNFSF5 (CD40 Ligand CD154/gp39/HIGMI/IMD3/TRAP), TNFSF6 (Fas Ligand Apo-1 Ligand/APT1 Ligand), TNFSF7 (CD27 Ligand CD70), TNFSF8 (CD30 Ligand CD153), TNFSF9 (4-1 BB Ligand CD137 Ligand), TNF-alpha, TNF-beta, TNIL-I, toxic metabolite, TP-1, t-PA, Tpo, TRAIL, TRAIL R, TRAIL-R1, TRAIL-R2, TRANCE, transferrin receptor, transforming growth factors (TGF) such as TGF-alpha and TGF-beta Transmembrane glycoprotein NMB, Transthyretin, TRF, Trk, TROP-2, Trophoblast glycoprotein, TSG, TSLP, Tumor Necrosis Factor (TNF), tumor-associated antigen CA 125, tumor-associated antigen expressing Lewis Y related carbohydrate, TWEAK, TXB2, Ung, uPAR, uPAR-1, Urokinase, VAP-1, vascular endothelial growth factor (VEGF), vaspin, VCAM, VCAM-1, VECAD, VE-Cadherin, VE-Cadherin-2, VEFGR-1 (flt-1), VEFGR-2, VEGF receptor (VEGFR), VEGFR-3 (flt-4), VEG1, VIM, Viral antigens, VitB12 receptor, Vitronectin receptor, VLA, VLA-1, VLA-4, VNR integrin, von Willebrand Factor (\WF), WIF-1, WNT1, WNT10A, WNT10B, WNT11, WNT16, WNT2, WNT2B/13, WNT3, WNT3A, WNT4, WNTSA, WNT5B, WNT6, WNT7A, WNT7B, WNT8A, WNT8B, WNT9A, WNT9B, XCL1, XCL2/SCM-1-beta, XCL1/Lymphotactin, XCR1, XEDAR, XIAP, XPD and Glypican-3 (GPC3).

In the present invention, a third antigen-binding domain in the antigen-binding molecule of the present invention binds to a "third antigen" that is different from the "first antigen" and the "second antigen" mentioned above. In some embodiments, the third antigen is derived from humans, mice, rats, monkeys, rabbits, or dogs. In some embodiments, the third antigen is a molecule specifically expressed on the cell or the organ derived from humans, mice, rats, monkeys, rabbits, or dogs. The third antigen is preferably, a molecule not systemically expressed on the cell or the organ. The third antigen is preferably, for example, a tumor cell-specific antigen and also includes an antigen expressed in association with the malignant alteration of cells as well as an abnormal sugar chain that appears on cell surface or a protein molecule during the malignant transformation of cells. Specific examples thereof include ALK receptor (pleiotrophin receptor), pleiotrophin, KS 1/4 pancreatic cancer antigen, ovary cancer antigen (CA125), prostatic acid phosphate, prostate-specific antigen (PSA), melanoma-associated antigen p97, melanoma antigen gp75, high-molecular-weight melanoma antigen (HMW-MAA), prostate-specific membrane antigen, carcinoembryonic antigen (CEA), polymorphic epithelial mucin antigen, human milk fat globule antigen, colorectal tumor-associated antigen (e.g., CEA. TAG-72, CO17-1A, GICA 19-9, CTA-1, and LEA). Burkitt's lymphoma antigen 38.13, CD19, human B lymphoma antigen CD20, CD33, melanoma-specific antigen (e.g., ganglioside GD2, ganghoside GD3, ganglioside GM2, and ganglioside GM3), tumor-specific transplantation antigen (TSTA), T antigen, virus-induced tumor antigen (e.g., envelope antigens of DNA tumor virus and RNA tumor virus), colon CEA, oncofetal antigen alpha-fetoprotein (e.g, oncofetal trophoblastic gly coprotein ST4 and oncofetal bladder tumor antigen), differentiation antigen (e.g, human lung cancer antigens L6 and L20), fibrosarcoma antigen, human T cell leukemia-associated antigen Gp37, new born glycoprotein, sphingolipid, breast cancer antigen (e.g, EGFR (epithelial growth factor receptor)), NY-BR-16, NY-BR-16 and HER2 antigen (p185HER2), poly morphic epithelial mucin (PEM), malignant human lymphocyte antigen APO-1, differentiation antigen such as I antigen found in fetal erythrocy tes, primary endoderm I antigen found in adult erythrocytes, 1 (Ma) found in embryos before transplantation or gastric cancer. M18 found in mammary gland epithelium, M39, SSEA-1 found in bone marrow cells, VEP8, VEP9, Myl. VIM-D5, D156-22 found in colorectal cancer. TRA-1-85 (blood group H). SCP-1 found in testis and ovary cancers, C14 found in colon cancer, F3 found in lung cancer. AH6 found in gastric cancer. Y hapten. Ley found in embryonic cancer cells, TL5 (blood group A), EGF receptor found in A431 cells, E1 series (blood group B) found in pancreatic cancer, FC10.2 found in embryonic cancer cells, gastric cancer antigen, CO-514 (blood group Lea) found in adenocarcinoma, NS-10 found in adenocarcinoma, CO-43 (blood group Leb), G49 found in A431 cell EGF receptor, MH2 (blood group ALeb/Ley) found in colon cancer, 19.9 found in colon cancer, gastric cancer mucin. T5A7 found in bone marrow cells, R24 found in melanoma, 4.2. GD3, DI.1, OFA-1, GM2, OFA-2, GD2, and M1: 22:25:8 found in embryonic cancer cells. SSEA-3 and SSEA-4 found in 4-cell to 8-cell embryos, cutaneous T cell lymphoma-associated antigen, MART-1 antigen, sialyl Tn (STn) antigen, colon cancer antigen NY-CO-45, lung cancer antigen NY-LU-12 variant A, adenocarcinoma antigen ART1, paraneoplastic associated brain-testis-cancer antigen (onconeuronal antigen MA2 and paraneoplastic neuronal antigen), neuro-oncological ventral antigen 2 (NOVA2), blood cell cancer antigen gene 520, tumor-associated antigen CO-029, tumor-associated antigen MAGE-C1 (cancer/testis antigen CT7), MAGE-B1 (MAGE-XP antigen), MAGE-B2 (DAM6), MAGE-2, MAGE-4a, MAGE-4b MAGE-X2, cancer-testis antigen (NY-EOS-1). YKL-40, and any fragment of these polypeptides, and modified structures thereof (aforementioned modified phosphate groups, sugar chains, etc.). EpCAM. EREG, CA19-9. CA15-3, sialyl SSEA-1 (SLX), HER2, PSMA, CEA, and CLEC12A.

In one preferred embodiment, the third antigen is a molecule specifically expressed in a cancer tissue, preferably Glypican-3 (GPC3).

In one aspect, an antigen-binding molecule of the present invention has at least one characteristic selected from the group consisting of (1) to (4) below, (1) At least one of a first antigen-binding domain or a second antigen-binding domain binds to an extracellular domain of CD3 epsilon (epsilon) comprising the amino acid sequence of SEQ ID NO: 159, (2) An antigen-binding molecule of the present invention has an agonistic activity against CD137, (3) An antigen-binding molecule of the present invention induces an activation of a T cell though binding to CD3 to give cytotoxicity against a cell expressing the molecule of the third antigen (e.g., tumor antigen on a cancer cell), but does not induce activation of a T cell via CD3 signaling or an immune cell expressing CD137, independently from the existence of cells expressing the third antigen (i.e., in the absence of a cell expressing the molecule of the third antigen), and (4) An antigen-binding molecule of the present invention does not induce release of a cytokine from PBMC in the absence of a cell expressing the molecule of the third antigen.

If the term of "CD137 agonist antibody" or "antigen-binding molecule having an agonistic activity against CD137" is used in the instant application, it refers to an antibody or an antigen-binding molecule that activates cells expressing CD137 by at least about 5%, specifically at least about 10%, or more specifically at least about 15% when added to the cells, tissues, or living bodies that express CD137, where 0% activation is the background level (e.g. IL6 secretion and so on) of the non-activation cells expressing CD137. In various specific examples, the "CD137 agonist antibody" or "antigen-binding molecule having an agonistic activity against CD137" for use as a pharmaceutical composition in the instant application can activate the activity of the cells by at least about 20%, 30%, 40%, 50%, 60%, 70%, 80%, 90%, 100%, 125%, 150%, 175%, 200%, 250%, 300%, 350%, 400%, 450%, 500%, 750%, or 1000%.

If the term of "CD137 agonist antibody" or "antigen-binding molecule having an agonistic activity against CD137" is used in the instant application, it also refers to an antibody or an antigen-binding molecule that activates cells expressing CD137 by at least about 5%, specifically at least about 10%, or more specifically at least about 15% when added to the cells, tissues, or living bodies that express CD137, where 100% activation is the level of activation achieved by an equimolar amount of a binding partner under physiological conditions. In various specific examples, the "CD137 agonist antibody" or "antigen-binding molecule having an agonistic activity against CD137" for use as a pharmaceutical composition in the present application can activate the activity of the cells by at least about 5%, 10%, 20%, 30%, 40%, 50%, 60%, 70%, 80%, 90%, 100%, 125%, 150%, 175%, 200%, 250%, 300%, 350%, 400%, 450%, 500%, 750%, or 1000%.

In some embodiments, the term "a binding partner" refers to a molecule which is known to bind to CD137 and induce the activation of cells expressing CD137. In further embodiments, examples of the binding partner include Urelumab (CAS Registry No. 934823-49-1) and its variants described in WO2005/035584A1, Utomilumab (CAS Registry No. 1417318-27-4) and its variants described in WO2012/032433A1, and various known CD137 agonist antibodies. In certain embodiments, examples of the binding partner include CD137 ligands. In further embodiments, the activation of cells expressing CD137 by an anti-CD137 agonist antibody or "antigen-binding molecule having an agonistic activity against CD137" may be determined using an ELISA to characterize IL6 secretion (See, e.g., Reference Example 5-2, herein). The anti-CD137 antibody or "antigen-binding molecule having an agonistic activity against CD137" used as the binding partner and the antibody concentration for the measurements can be referred to Reference Example 5-2, where 100% activation is the level of activation achieved by the antibody or the antigen-binding molecule. In further embodiments, an antibody comprising the heavy chain amino acid sequence of SEQ ID NO: 142 and the light chain amino acid sequence of SEQ ID NO: 144 can be used at 30 micro g/mL for the measurements as the binding partner (See, e.g., Reference Example 5-2, herein).

As a non-limiting embodiment, the present invention provides a "CD137 agonist antibody" or "antigen-binding molecule having an agonistic activity against CD137" comprising an Fc region, wherein the Fc region has an enhanced binding activity towards an inhibitory Fc gamma receptor.

As a non-limiting embodiment, the CD137 agonistic activity can be confirmed using B cells, which are known to express CD137 on their surface. As a non-limiting embodiment. HDLM-2 B cell line can be used as B cells. The CD137 agonistic activity can be evaluated by the amount of human Interleukin-6 (IL-6) produced because the expression of IL-6 is induced as a result of the activation of CD137. In this evaluation, it is possible to determine how much % of CD137 agonistic activity the evaluated molecule has by evaluating the increased amount of IL-6 expression by using the amount of IL-6 from non-activating B cells as 0% background level.

In some embodiments, the antigen-binding molecule of the present invention induces an activation of a T cell though binding to CD3 to give cytotoxicity against a cell expressing the molecule of the third antigen (e.g., tumor antigen on a cancer cell), but does not induce an activation of T cells or an immune cell expressing CD137, independently from the existence of cells expressing the third antigen (i.e., in the absence of a cell expressing the molecule of the third antigen). Whether an antigen-binding molecule induces an activation of a T cell though binding to CD3 to give cytotoxicity against a cell expressing the molecule of the third antigen can be determined by, for example, co-culturing T cells with cells expressing the third antigen in the presence of the antigen-binding molecule, and assaying an activation of the T cells via CD3 signaling. T cell activation can be assayed by, for example, using recombinant T cells that express a reporter gene (e.g. luciferase) in response to CD3 signaling, and detecting the expression of the reporter gene or the activity of the reporter gene product as an index of the activation of the T cells. When recombinant T cells that express a reporter gene in response to CD3 signaling are co-cultured with cells expressing a third antigen in the presence of an antigen-binding molecule, detection of the expression of the reporter gene or the activity of the reporter gene product in a manner dependent on the dose of the antigen-binding molecule indicates that the antigen-binding molecule induces activation of T cells against cells expressing the third antigen.

Similarly, whether an antigen-binding molecule does not induce an activation of T cells via CD3 signaling against cells expressing CD137 independently from the existence of cells expressing the third antigen (i.e., in the absence of a cell expressing the molecule of the third antigen) can be determined by, for example, co-culturing T cells with cells expressing CD137 in the presence of the antigen-binding molecule, and assaying CD3 activation of the T cells as described above. When recombinant T cells that express a reporter gene in response to CD3 signaling are co-cultured with cells expressing CD137 in the presence of an antigen-binding molecule, the antigen-binding molecule is determined not to induce activation of T cells against cells expressing CD137 if the expression of the reporter gene or the activity of the reporter gene product is absent or below a detection limit or below that of negative control. In one aspect, when recombinant T cells that express a reporter gene in response to CD3 signaling are co-cultured with cells expressing CD137 in the presence of an antigen-binding molecule, the antigen-binding molecule is determined not to induce activation of T cells against cells expressing CD137 if the expression of the reporter gene or the activity of the reporter gene product is at most about 50%, 30%, 20%, 10%, 5% or 1%, where 100% activation is the level of activation achieved by an antigen-binding molecule which binds to CD3 and CD137 at the same time. In one aspect, when recombinant T cells that express a reporter gene in response to CD3 signaling are co-cultured with cells expressing CD137 in the presence of an antigen-binding molecule, the antigen-binding molecule is determined not to induce activation of T cells against cells expressing CD137 if the expression of the reporter gene or the activity of the reporter gene product is at most about 50%, 30%, 20%, 10%, 5% or 1%, where 100% activation is the level of activation achieved by the same antigen-binding molecule against cells expressing the molecule of a third antigen.

In some embodiments, the antigen-binding molecule of the present invention does not induce a cytokine release from PBMCs in the absence of cells expressing the molecule of a third antigen. Whether an antigen-binding molecule does not induce release of cytokines in the absence of cells expressing a third antigen can be determined by, for example, incubating PBMCs with the antigen-binding molecule in the absence of cells expressing a third antigen, and measuring cytokines such as IL-2, IFN gamma, and TNF alpha released from the PBMCs into the culture supernatant using methods known in the art. If no significant levels of cytokines are detected or no significant induction of cytokines expression occurred in the culture supernatant of PBMCs that have been incubated with an antigen-binding molecule in the absence of cells expressing a third antigen, the antigen-binding molecule is determined not to induce a cytokine release from PBMCs in the absence of cells expressing a third antigen.

In one aspect. "no significant levels of cytokines" also refers to the level of cytokines concentration that is about at most 50%, 30%, 20%, 10%, 5% or 1%, where 100% is the cytokine concentration achieved by an antigen-binding molecule which binds to the first antigen (CD3) and the second antigen (CD137) at the same time. In one aspect, "no significant levels of cytokines" also refers to the level of cytokines concentration that is about at most 50%, 30%, 20%, 10%, 5% or 1%, where 100% is the cytokine concentration achieved in the presence of cells expressing the molecule of a third antigen. In one aspect, "no significant induction of cytokines expression" also refers to the level of cytokines concentration increase that is at most 5-fold, 2-fold or 1-fold of the concentration of each cytokines before adding the antigen-binding molecules.

In some embodiments, as far as the binding to CD137 is concerned, an antigen-binding molecule of the present invention competes for binding to CD137 with an antibody selected from the group consisting of;

(a) an antibody comprising a VH region having the amino acid sequence of SEQ ID NO: 104 and a VL region having the amino acid sequence of SEQ ID NO: 124,
(b) an antibody comprising a VH region having the amino acid sequence of SEQ ID NO: 119 and a VL region having the amino acid sequence of SEQ ID NO: 126,
(c) an antibody comprising a VH region having the amino acid sequence of SEQ ID NO: 114 and a VL region having the amino acid sequence of SEQ ID NO: 129,
(d) an antibody comprising a VH region having the amino acid sequence of SEQ ID NO: 104 and a VL region having the amino acid sequence of SEQ ID NO: 131,
(e) an antibody comprising a VH region having the amino acid sequence of SEQ ID NO: 114 and a VL region having the amino acid sequence of SEQ ID NO: 134,
(f) an antibody comprising a VH region having the amino acid sequence of SEQ ID NO: 1 and a VL region having the amino acid sequence of SEQ ID NO: 45,
(g) an antibody comprising a VH region having the amino acid sequence of SEQ ID NO: 2 and a VL region having the amino acid sequence of SEQ ID NO: 46,
(h) an antibody comprising a VH region having the amino acid sequence of SEQ ID NO: 3 and a VL region having the amino acid sequence of SEQ ID NO: 45,
(i) an antibody comprising a VH region having the amino acid sequence of SEQ ID NO: 4 and a VL region having the amino acid sequence of SEQ ID NO: 45,
(j) an antibody comprising a VH region having the amino acid sequence of SEQ ID NO: 5 and a VL region having the amino acid sequence of SEQ ID NO: 45,
(k) an antibody comprising a VH region having the amino acid sequence of SEQ ID NO: 6 and a VL region having the amino acid sequence of SEQ ID NO: 45,
(l) an antibody comprising a VH region having the amino acid sequence of SEQ ID NO: 7 and a VL region having the amino acid sequence of SEQ ID NO: 45,
(m) an antibody comprising a VH region having the amino acid sequence of SEQ ID NO: 8 and a VL region having the amino acid sequence of SEQ ID NO: 45,
(n) an antibody comprising a VH region having the amino acid sequence of SEQ ID NO: 9 and a VL region having the amino acid sequence of SEQ ID NO: 45,
(o) an antibody comprising a VH region having the amino acid sequence of SEQ ID NO: 10 and a VL region having the amino acid sequence of SEQ ID NO: 46,
(p) an antibody comprising a VH region having the amino acid sequence of SEQ ID NO: 11 and a VL region having the amino acid sequence of SEQ ID NO: 48, and
(q) an antibody comprising a VH region having the amino acid sequence of SEQ ID NO: 61 and a VL region having the amino acid sequence of SEQ ID NO: 48.

In some embodiments, as far as the binding to the CD137 is concerned, an antigen-binding molecule of the present invention binds to the same epitope of CD137 molecule as an antibody selected from the group consisting of, (a) an antibody comprising a VH region having the amino acid sequence of SEQ ID NO: 104 and a VL region having the amino acid sequence of SEQ ID NO: 124,
(b) an antibody comprising a VH region having the amino acid sequence of SEQ ID NO: 119 and a VL region having the amino acid sequence of SEQ ID NO: 126,
(c) an antibody comprising a VH region having the amino acid sequence of SEQ ID NO: 114 and a VL region having the amino acid sequence of SEQ ID NO: 129,
(d) an antibody comprising a VH region having the amino acid sequence of SEQ ID NO: 104 and a VL region having the amino acid sequence of SEQ ID NO: 131, (e) an antibody comprising a VH region having the amino acid sequence of SEQ ID NO: 114 and a VL region having the amino acid sequence of SEQ ID NO: 134,
(f) an antibody comprising a VH region having the amino acid sequence of SEQ ID NO: 1 and a VL region having the amino acid sequence of SEQ ID NO: 45,
(g) an antibody comprising a VH region having the amino acid sequence of SEQ ID NO: 2 and a VL region having the amino acid sequence of SEQ ID NO: 46,
(h) an antibody comprising a VH region having the amino acid sequence of SEQ ID NO: 3 and a VL region having the amino acid sequence of SEQ ID NO: 45,
(i) an antibody comprising a VH region having the amino acid sequence of SEQ ID NO: 4 and a VL region having the amino acid sequence of SEQ ID NO: 45,
(i) an antibody comprising a VH region having the amino acid sequence of SEQ ID NO: 5 and a VL region having the amino acid sequence of SEQ ID NO: 45,
(k) an antibody comprising a VH region having the amino acid sequence of SEQ ID NO: 6 and a VL region having the amino acid sequence of SEQ ID NO: 45,
(l) an antibody comprising a VH region having the amino acid sequence of SEQ ID NO: 7 and a VL region having the amino acid sequence of SEQ ID NO: 45,
(m) an antibody comprising a VH region having the amino acid sequence of SEQ ID NO: 8 and a VL region having the amino acid sequence of SEQ ID NO: 45,
(n) an antibody comprising a VH region having the amino acid sequence of SEQ ID NO: 9 and a VL region having the amino acid sequence of SEQ ID NO: 45,
(o) an antibody comprising a VH region having the amino acid sequence of SEQ ID NO: 10 and a VL region having the amino acid sequence of SEQ ID NO: 46,
(p) an antibody comprising a VH region having the amino acid sequence of SEQ ID NO: 11 and a VL region having the amino acid sequence of SEQ ID NO: 48, and
(q) an antibody comprising a VH region having the amino acid sequence of SEQ ID NO: 61 and a VL region having the amino acid sequence of SEQ ID NO: 48.

In some embodiments, as far as the binding to CD137 is concerned, an antigen-binding molecule of the present invention may has an activity equivalent to any one of the above (a) to (q). Here, the "equivalent activity" refers to a CD137 agonist activity that is 70% or more, preferably 80% or more, and more preferably 90% or more of the binding activity of any one of the above (a) to (g).

Whether a test antigen-binding molecule of the present invention shares a common epitope with a certain antibody as listed above can be assessed based on competition between the two for the same epitope. The competition between the two can be detected by a cross-blocking assay or the like. For example, the competitive ELISA assay is a preferred cross-blocking assay. Specifically, in a cross-blocking assay, the CD137 protein used to coat the wells of a microtiter plate is pre-incubated in the presence or absence of a candidate competitor antibody, and then an antigen-binding molecule of the present invention is added thereto. The amount of the antigen-binding molecule of the present invention bound to the CD137 protein in the wells is indirectly correlated with the binding ability of a candidate competitor antibody (test antibody) that competes for the binding to the same epitope. That is, the greater the affinity of the test antibody for the same epitope, the lower the amount of the antigen-binding molecule of the present invention bound to the CD137 protein-coated wells, and the higher the amount of the test antibody bound to the CD137 protein-coated wells.

The amount of the antigen-binding molecule of the present invention bound to the wells can be readily determined by labeling the antigen-binding molecule in advance. For example, a biotin-labeled antigen-binding molecule can be measured using an avidin/peroxidase conjugate and an appropriate substrate. In particular, a cross-blocking assay that uses enzyme labels such as peroxidase is called a "competitive ELISA assay". The antigen-binding molecule of the present invention can be labeled with other labeling substances that enable detection or measurement. Specifically, radiolabels, fluorescent labels, and such are known.

Furthermore, when the test antibody has a constant region derived from a species different from that of the antigen-binding molecule of the present invention, the amount of antigen-binding molecule of the present invention bound to the wells can be measured by using a labeled antibody that recognizes the constant region of that antigen-binding molecule. Alternatively, if the test antibody and antigen-binding molecule of the present invention are derived from the same species but belong to different classes, the amount of the two bound to the wells can be measured using antibodies that distinguish individual classes.

If a candidate antigen-binding molecule of the present invention can block binding of an anti-CD137 antibody by at least 20%, preferably by at least 20% to 50%, and even more preferably, by at least 50%, as compared to the binding activity obtained in a control experiment performed in the absence of the candidate competing antigen-binding molecule of the present invention, the candidate competing antigen-binding molecule of the present invention is either an antigen-binding molecule that binds substantially to the same epitope or an antigen-binding molecule that competes for binding to the same epitope as an anti-CD137 antibody.

In another embodiment, the ability of a test antibody or an antigen-binding molecule to competitively or cross competitively bind with another antibody or an antigen-binding molecule can be appropriately determined by those skilled in the art using a standard binding assay such as BIAcore analysis or flow cytometry known in the art.

Methods for determining the spatial conformation of an epitope include, for example, X ray crystallography and two-dimensional nuclear magnetic resonance (see, Epitope Mapping Protocols in Methods in Molecular Biology, G. E. Morris (ed.), Vol. 66 (1996)).

Whether a test antibody or an antigen-binding molecule shares a common epitope with a CD137 ligand can also be assessed based on competition between the test antibody or an antigen-binding molecule and CD137 ligand for the same epitope. The competition between antibody or an antigen-binding molecule, and CD137 ligand can be detected by a cross-blocking assay or the like as mentioned above. In another embodiment, the ability of a test antibody or an antigen-binding molecule to competitively or cross competitively bind with CD137 ligand can be appropriately determined by those skilled in the art using a standard binding assay such as BIAcore analysis or flow cytometry known in the art.

In some embodiments, as far as the binding to CD137 is concerned, favorable examples of an antigen-binding molecule of the present invention include antigen-binding molecules that bind to the same epitope as the human CD137 epitope bound by the antibody selected from the group consisting of;

antibody that recognize a region comprising the SPCPPNSESSAGGQRTCD ICRQCKGVFRTRKE- CSSTSNAECDCTPGFHCL-GAGCSMCEQDCKQGQELTKKG C sequence (SEQ ID NO: 154).

antibody that recognize a region comprising the DCTPGFHCLGAGCSMCEQDC KQGQELTKKGC sequence (SEQ ID NO: 149).

antibody that recognize a region comprising the LQDPCSNC PAGTFCDNNRNQICSPCPPNSFS-SAGGQRTCDICRQCKGVFRTRKECSSTSNAEC sequence (SEQ ID NO: 152), and antibody that recognize a region comprising the LQDPCSNCPAGTFCDNNRN QIC sequence (SEQ ID NO: 147) in the human CD137 protein.

Depending on the targeted cancer antigen, those skilled in the art can appropriately select a heavy chain variable region sequence and a light chain variable region sequence that bind to the cancer antigen for the heavy chain variable region and the light chain variable region to be included in the cancer-specific antigen-binding domain. When an epitope bound by an antigen-binding domain is contained in multiple different antigens, antigen-binding molecules containing the antigen-binding domain can bind to various antigens that have the epitope.

"Epitope" means an antigenic determinant in an antigen, and refers to an antigen site to which various binding domains in antigen-binding molecules disclosed herein bind. Thus, for example, an epitope can be defined according to its structure. Alternatively, the epitope may be defined according to the antigen-binding activity of an antigen-binding molecule that recognizes the epitope. When the antigen is a peptide or polypeptide, the epitope can be specified by the amino acid residues that form the epitope. Alternatively, when the epitope is a sugar chain, the epitope can be specified by its specific sugar chain structure.

A linear epitope is an epitope that contains an epitope whose primary amino acid sequence is recognized. Such a linear epitope typically contains at least three and most commonly at least five, for example, about 8 to 10 or 6 to 20 amino acids in its specific sequence.

In contrast to the linear epitope, "conformational epitope" is an epitope in which the primary amino acid sequence containing the epitope is not the only determinant of the recognized epitope (for example, the primary amino acid sequence of a conformational epitope is not necessarily recognized by an epitope-defining antibody). Conformational epitopes may contain a greater number of amino acids compared to linear epitopes. A conformational epitope-recognizing antibody or antigen-binding molecule recognizes the three-dimensional structure of a peptide or protein. For example, when a protein molecule folds and forms a three dimensional structure, amino acids and/or polypeptide main chains that form a conformational epitope become aligned, and the epitope is made recognizable by the antibody. Methods for determining epitope conformations include, for example, X ray crystallography, two-dimensional nuclear magnetic resonance spectroscopy, site-specific spin labeling, and electron paramagnetic resonance spectroscopy, but are not limited thereto. See, for example, Epitope Mapping Protocols in Methods in Molecular Biology (1996), Vol. 66, Morris (ed).

Examples of a method for assessing the binding of an epitope in a cancer-specific antigen by a test antigen-binding molecule are shown below. According to the examples below, methods for assessing the binding of an epitope in a target antigen by another binding domain can also be appropriately conducted.

For example, whether a test antigen-binding molecule that comprises an antigen-binding domain for a cancer-specific antigen recognizes a linear epitope in the antigen molecule can be confirmed for example as mentioned below. For example, a linear peptide comprising an amino acid sequence forming the extracellular domain of a cancer-specific antigen is synthesized for the above purpose. The peptide can be synthesized chemically, or obtained by genetic engineering techniques using a region in a cDNA of a cancer-specific antigen encoding the amino acid sequence that corresponds to the extracellular domain. Then, a test antigen-binding molecule containing an antigen-binding domain for a cancer-specific antigen is assessed for its binding activity towards a linear peptide comprising the extracellular domain-constituting amino acid sequence. For example, an immobilized linear peptide can be used as an antigen to evaluate the binding activity of the antigen-binding molecule towards the peptide by ELISA. Alternatively, the binding activity towards a linear peptide can be assessed based on the level at which the linear peptide inhibits binding of the antigen-binding molecule to cancer-specific antigen-expressing cells. The binding activity of the antigen-binding molecule towards the linear peptide can be demonstrated by these tests.

Whether the above-mentioned test antigen-binding molecule containing an antigen-binding domain towards an antigen recognizes a conformational epitope can be confirmed as below. For example, an antigen-binding molecule that comprises an antigen-binding domain for a cancer-specific antigen strongly binds to cancer-specific antigen-expressing cells upon contact, but does not substantially bind to an immobilized linear peptide comprising an amino acid sequence forming the extracellular domain of the cancer-specific antigen. Herein, "does not substantially bind" means that the binding activity is 80% or less, generally 50% or less, preferably 30% or less, and particularly preferably 15% or less compared to the binding activity to antigen-expressing cells, of ELISA or fluorescence activated cell sorting (FACS) using antigen-expressing cells as antigen.

In the ELISA format, the binding activity of a test antigen-binding molecule comprising an antigen-binding domain towards antigen-expressing cells can be assessed quantitatively by comparing the levels of signals generated by enzymatic reaction. Specifically, a test antigen-binding molecule is added to an ELISA plate onto which antigen-expressing cells are immobilized. Then, the test antigen-binding molecule bound to the cells is detected using an enzyme-labeled antibody that recognizes the test antigen-binding molecule. Alternatively, when FACS is used, a dilution series of a test antigen-binding molecule is prepared, and the antibody-binding titer for antigen-expressing cells can be determined to compare the binding activity of the test antigen-binding molecule towards antigen-expressing cells.

The binding of a test antigen-binding molecule to an antigen expressed on the surface of cells suspended in buffer or the like can be detected using a flow cytometer. Known flow cytometers include, for example, the following devices:

FACSCanto™ II
FACS Aria™
FACS Array™
FACSVantage™ SE
FACSCalibur™ (all are trade names of BD Biosciences)
EPICS ALTRA HyPerSort
Cytomics FC 500
EPICS XL-MCL ADC EPICS XL ADC Cell Lab Quanta/Cell Lab Quanta SC (all are trade names of Beckman Coulter).

Suitable methods for assaying the binding activity of the above-mentioned test antigen-binding molecule comprising an antigen-binding domain towards an antigen include, for example, the method below. First, antigen-expressing cells are reacted with a test antigen-binding molecule, and then this is stained with an FITC-labeled secondary using FACSCalibur (BD). The fluorescence intensity obtained by analysis using the CELL QUEST Software (BD), i.e., the Geometric Mean value, reflects the quantity of antibody bound to the cells. That is, the binding activity of a test antigen-binding molecule, which is represented by the quantity of the test antigen-binding molecule bound, can be measured by determining the Geometric Mean value.

Whether a test antigen-binding molecule comprising an antigen-binding domain of the present invention shares a common epitope with another antigen-binding molecule can be assessed based on competition between the two molecules for the same epitope. The competition between antigen-binding molecules can be detected by a cross-blocking assay or the like. For example, the competitive ELISA assay is a preferred cross-blocking assay.

Specifically, in a cross-blocking assay, the antigen coating the wells of a microtiter plate is pre-incubated in the presence or absence of a candidate competitor antigen-binding molecule, and then a test antigen-binding molecule is added thereto. The quantity of test antigen-binding molecule bound to the antigen in the wells indirectly correlates with the binding ability of a candidate competitor antigen-binding molecule that competes for the binding to the same epitope. That is, the greater the affinity of the competitor antigen-binding molecule for the same epitope, the lower the binding activity of the test antigen-binding molecule towards the antigen-coated wells.

The quantity of the test antigen-binding molecule bound to the wells via the antigen can be readily determined by labeling the antigen-binding molecule in advance. For example, a biotin-labeled antigen-binding molecule can be measured using an avidin/peroxidase conjugate and appropriate substrate. In particular, a cross-blocking assay that uses enzyme labels such as peroxidase is called "competitive ELISA assay". The antigen-binding molecule can also be labeled with other labeling substances that enable detection or measurement. Specifically, radiolabels, fluorescent labels, and such are known.

When the candidate competitor antigen-binding molecule can block the binding of a test antigen-binding molecule comprising an antigen-binding domain by at least 20%, preferably at least 20 to 50%, and more preferably at least 50% compared to the binding activity in a control experiment conducted in the absence of the competitor antigen-binding molecule, the test antigen-binding molecule is determined to substantially bind to the same epitope bound by the competitor antigen-binding molecule, or to compete for binding to the same epitope.

When the structure of an epitope bound by a test antigen-binding molecule comprising an antigen-binding domain of the present invention is already identified, whether the test and control antigen-binding molecules share a common epitope can be assessed by comparing the binding activities of the two antigen-binding molecules towards a peptide prepared by introducing amino acid mutations into the peptide forming the epitope.

As a method for measuring such binding activities, for example, the binding activities of test and control antigen-binding molecules towards a linear peptide into which a mutation is introduced are measured by comparison in the above ELISA format. Besides the ELISA methods, the binding activity towards the mutant peptide bound to a column can be determined by passing the test and control antigen-binding molecules through the column, and then quantifying the antigen-binding molecule eluted in the eluate. Methods for adsorbing a mutant peptide to a column, for example, in the form of a GST fusion peptide, are known.

Alternatively, when the identified epitope is a conformational epitope, whether test and control antigen-binding molecules share a common epitope can be assessed by the following method. First, cells expressing an antigen targeted by an antigen-binding domain and cells expressing an antigen having an epitope introduced with a mutation are prepared. The test and control antigen-binding molecules are added to a cell suspension prepared by suspending these cells in an appropriate buffer such as PBS. Then, the cell suspension is appropriately washed with a buffer, and an FITC-labeled antibody that can recognize the test and control antigen-binding molecules is added thereto. The fluorescence intensity and number of cells stained with the labeled antibody are determined using FACSCalibur (BD). The test and control antigen-binding molecules are appropriately diluted using a suitable buffer, and used at desired concentrations. For example, they may be used at a concentration within the range of 10 micro g/ml to 10 ng/ml. The fluorescence intensity determined by analysis using the CELL QUEST Software (BD), i.e., the Geometric Mean value, reflects the quantity of the labeled antibody bound to the cells. That is, the binding activities of the test and control antigen-binding molecules, which are represented by the quantity of the labeled antibody bound, can be measured by determining the Geometric Mean value.

In some embodiments, an antigen-binding molecule of the present invention comprises an amino acid sequence resulting from introducing alteration of one or more amino acids into a template sequence consisting of a heavy chain variable region sequence described in SEQ ID NO: 160 and/or a light chain variable region sequence described in SEQ ID NO: 161, and the one or more amino acids to be altered are selected from the following positions:

H chain: 31, 52b, 52c, 53, 54, 56, 57, 61, 98, 99, 100, 100a, 100b, 100c, 100d, 100e, 100f, and 100g (Kabat numbering); and L chain: 24, 25, 26, 27, 27a, 27b, 27c, 27e, 30, 31, 33, 34, 51, 52, 53, 54, 55, 56, 74, 77, 89, 90, 92, 93, 94, and 96 (Kabat numbering), wherein the HVR-H3 of the altered heavy chain variable region sequence comprises at least one amino acid selected from:

Ala, Pro, Ser, Arg, His or Thr at amino acid position 98;
Ala, Ser, Thr, Gln, His or Leu at amino acid position 99;
Tyr, Ala, Ser, Pro or Phe at amino acid position 100,
Tyr, Val, Ser, Leu or Gly at amino acid position 100a;
Asp, Ser, Thr, Leu, Gly or Tyr at amino acid position 100b;
Val, Leu, Phe, Gly, His or Ala at amino acid position 100c;
Leu, Phe, Ile or Tyr at amino acid position 100d;
Gly, Pro, Tyr, Gln, Ser or Phe at amino acid position 100e;
Tyr, Ala, Gly, Ser or Lys at amino acid position 100f;
Gly, Tyr, Phe or Val at amino acid position 100g (Kabat numbering).

In some embodiments, an antigen-binding molecule of the present invention comprises (a) a VH region comprising the amino acid sequence having at least 95% sequence identity to the amino acid sequence of SEQ ID NO: 115, 104, 119 or 114; (b) a VL region comprising the amino acid sequence having at least 95% sequence identity to the amino acid sequence of SEQ ID NO: 124-130; or (c) the VH region comprising the amino acid sequence of (a) and the VL region comprising the amino acid sequence of (b).

The antigen-binding molecule of the present invention can be produced by a method generally known to those skilled in the art. For example, the antigen-binding molecule of the present invention can be prepared by a method in accordance with or referring to the method for preparing an antibody given below, though the method for preparing the antigen-binding molecule of the present invention is not limited thereto. Many combinations of host cells and expression vectors are known in the art for antibody preparation by the transfer of isolated genes encoding polypeptides into appropriate hosts. All of these expression systems can be applied to the isolation of the antigen-binding molecule of the present invention. In the case of using eukaryotic cells as the host cells, animal cells, plant cells, or fungus cells can be appropriately used. Specifically, examples of the animal cells can include the following cells;

(1) mammalian cells such as CHO (Chinese hamster ovary cell line), COS (monkey kidney cell line), myeloma cells (Sp2/O. NS0, etc.), BHK (baby hamster kidney cell line), HEK293 (human embryonic kidney cell line with sheared adenovirus (Ad) 5 DNA), PER.C6 cell (human embryonic retinal cell line transformed with the adenovirus type 5 (Ad5) EIA and EIB genes), Hela, and Vero (Current Protocols in Protein Science (May 2001, Unit 5.9, Table 5.9.1));
(2) amphibian cells such as Xenopus oocytes; and
(3) insect cells such as sf9, sf21, and TnS.

The antigen-binding molecule of the present invention can also be prepared using *E. coli* (mAbs 2012 March-April; 4 (2): 217-225) or yeast (WO2000023579). The antibody and antigen-binding molecule prepared using *E. coli* is not glycosylated. On the other hand, the antibody and antigen-binding molecule prepared using yeast is glycosylated.

An antibody heavy chain-encoding DNA that encodes a heavy chain with one or more amino acid residues in a variable domain substituted by different amino acids of interest, and a DNA encoding a light chain of the antibody are expressed. The DNA that encodes a heavy chain or a light chain with one or more amino acid residues in a variable domain substituted by different amino acids of interest can be obtained, for example, by obtaining a DNA encoding an antibody variable domain prepared by a method known in the art against a certain antigen, and appropriately introducing substitution such that codons encoding the particular amino acids in the domain encode the different amino acids of interest.

Alternatively, a DNA encoding a protein in which one or more amino acid residues in an antibody variable domain prepared by a method known in the art against a certain antigen are substituted by different amino acids of interest may be designed in advance and chemically synthesized to obtain the DNA that encodes a heavy chain with one or more amino acid residues in a variable domain substituted by different amino acids of interest. The amino acid substitution site and the type of the substitution are not particularly limited. Examples of the region preferred for the amino acid alteration include solvent-exposed regions and loops in the variable region. Among others, CDR1, CDR2, CDR3, FR3, and loops are preferred. Specifically, Kabat numbering positions 31 to 35, 50 to 65, 71 to 74, and 95 to 102 in the H chain variable domain and Kabat numbering positions 24 to 34, 50 to 56, and 89 to 97 in the L chain variable domain are preferred. Kabat numbering positions 31, 52a to 61, 71 to 74, and 97 to 101 in the H chain variable domain and Kabat numbering positions 24 to 34, 51 to 56, and 89 to 96 in the L chain variable domain are more preferred.

The amino acid alteration is not limited to the substitution and may be deletion, addition, insertion, or modification, or a combination thereof.

The DNA that encodes a heavy chain with one or more amino acid residues in a variable domain substituted by different amino acids of interest can also be produced as separate partial DNAs. Examples of the combination of the partial DNAs include, but are not limited to: a DNA encoding a variable domain and a DNA encoding a constant domain; and a DNA encoding a Fab domain and a DNA encoding an Fc domain. Likewise, the light chain-encoding DNA can also be produced as separate partial DNAs.

These DNAs can be expressed by the following method: for example, a DNA encoding a heavy chain variable region, together with a DNA encoding a heavy chain constant region, is integrated to an expression vector to construct a heavy chain expression vector. Likewise, a DNA encoding a light chain variable region, together with a DNA encoding a light chain constant region, is integrated to an expression vector to construct a light chain expression vector. These heavy chain and light chain genes may be integrated to a single vector.

The DNA encoding the antibody of interest is integrated to expression vectors so as to be expressed under the control of expression control regions, for example, an enhancer and a promoter. Next, host cells are transformed with the resulting expression vectors and allowed to express antibodies. In this case, appropriate hosts and expression vectors can be used in combination.

Examples of the vectors include M13 series vectors, pUC series vectors, pBR322, pBluescript, and pCR-Script. In addition to these vectors, for example, pGEM-T, pDIRECT, or pT7 can also be used for the purpose of cDNA subcloning and excision.

Particularly, expression vectors are useful for using the vectors for the purpose of producing the antibody of the present invention. For example, when the host is *E. coli* such as JM109, DH5 alpha, HB101, or XLI-Blue, the expression vectors indispensably have a promoter that permits efficient expression in *E. coli*, for example, lacZ promoter (Ward et al., Nature (1989) 341, 544-546; and FASEB J. (1992) 6, 2422-2427, which are incorporated herein by reference in their entirety), arab promoter (Better et al., Science (1988) 240, 1041-1043, which is incorporated herein by reference in its entirety), or T7 promoter. Examples of such vectors include the vectors mentioned above as well as pGEX-5X-1 (manufactured by Pharmacia), "QIAexpress system" (manufactured by Qiagen N. V.), pEGFP, and pET (in this case, the host is preferably BL21 expressing T7 RNA polymerase).

The vectors may contain a signal sequence for polypeptide secretion. In the case of production in the periplasm of *E. coli*, pelB signal sequence (Lei, S. P. et al., J. Bacteriol. (1987) 169, 4397, which is incorporated herein by reference in its entirety) can be used as the signal sequence for polypeptide secretion. The vectors can be transferred to the host cells by use of, for example, a Lipofectin method, a calcium phosphate method, or a DEAE-dextran method.

In addition to the expression vectors for *E. coli*, examples of the vectors for producing the antigen-binding molecule of the present invention include mammal-derived expression vectors (e.g., pcDNA3 (manufactured by Invitrogen Corp.), pEGF-BOS (Nucleic Acids. Res. 1990, 18 (17), p. 5322, which is incorporated herein by reference in its entirety), pEF, and pCDM8), insect cell-derived expression vectors (e.g., "Bac-to-BAC baculovirus expression system" (manufactured by GIBCO BRL), and pBacPAK8), plant-derived expression vectors (e.g., pMH1 and pMH2), animal virus-derived expression vectors (e.g., pHSV, pMV, and pAdexLcw), retrovirus-derived expression vectors (e.g., pZIPneo), yeast-derived expression vectors (e.g., "Pichia Expression Kit" (manufactured by Invitrogen Corp.), pNV11, and SP-Q01), and *Bacillus subtilis*-derived expression vectors (e.g., pPL608 and pKTH50).

For the purpose of expression in animal cells such as CHO cells. COS cells, NIH3T3 cells, or HEK293 cells, the vectors indispensably have a promoter necessary for intracellular expression, for example, SV40 promoter (Mulligan et al., Nature (1979) 277, 108, which is incorporated herein by reference in its entirety), MMTV-LTR promoter, EF1 alpha promoter (Mizushima et al., Nucleic Acids Res. (1990) 18, 5322, which is incorporated herein by reference in its entirety). CAG promoter (Gene (1991) 108, 193, which is incorporated herein by reference in its entirety), or CMV promoter and, more preferably, have a gene for screening for transformed cells (e.g., a drug resistance gene that can work as a marker by a drug (neomycin, G418, etc.)). Examples of the vectors having such properties include pMAM, pDR2, pBK-RSV, pBK-CMV, pOPRSV, and pOP13. In addition, EBNA1 protein may be coexpressed therewith for the purpose of increasing the number of gene copies. In this case, vectors having a replication origin OriP are used (Biotechnol Bioeng. 2001 Oct. 20; 75 (2): 197-203; and Biotechnol Bioeng 2005 Sep. 20:91 (6): 670-7).

An exemplary method intended to stably express the gene and increase the number of intracellular gene copies involves transforming CHO cells deficient in nucleic acid synthesis pathway with vectors having a DHFR gene serving as a complement thereto (e.g., pCHOI) and using methotrexate (MTX) in the gene amplification. An exemplary method intended to transiently express the gene involves using COS cells having an SV40 T antigen gene on their chromosomes to transform the cells with vectors having a replication origin of SV40 (pcD, etc.). A replication origin derived from polyomavirus, adenovirus, bovine papillomavirus (BPV), or the like can also be used. In order to increase the number of gene copies in the host cell system, the expression vectors can contain a selective marker such as an aminoglycoside phosphotransferase (APH) gene, a thymidine kinase (TK) gene, an *E. coli* xanthine guanine phosphoribosyltransferase (Ecogpt) gene, or a dihydrofolate reductase (dhfr) gene.

The antigen-binding molecule of the present invention can be recovered, for example, by culturing the transformed cells and then separating the antibody from within the molecule-transformed cells or from the culture solution thereof. The antigen-binding molecule of the present invention can be separated and purified by appropriately using in combination methods such as centrifugation, ammonium sulfate fractionation, salting out, ultrafiltration. C1q, FcRn, protein A and protein G columns, affinity chromatography, ion-exchanged chromatography, and gel filtration chromatography.

The technique mentioned above, such as the knobs-into-holes technology (WO1996/027011; Ridgway J B et al., Protein Engineering (1996) 9, 617-621; and Merchant A M et al., Nature Biotechnology (1998) 16, 677-681) or the technique of suppressing the unintended association between H chains by the introduction of electric charge repulsion (WO2006/106905), can be applied to a method for efficiently preparing the multispecific antigen-binding molecule.

The present inventors have also successfully developed the methods to obtain antigen binding domains which bind to two or more different antigens more efficiently.

In some embodiments, a method of screening for an antigen-binding domain which binds to at least two or more different antigens of interest of the present invention comprises;

(a) providing a library comprising a plurality of antigen-binding domains, (b) contacting the library provided in step (a) with a first antigen of interest and collecting antigen-binding domains bound to the first antigen, (c) contacting the antigen-binding domains collected in step (b) with a second antigen of interest and collecting antigen-binding domains bound to the second antigen, and (d) amplifying genes which encode the antigen binding domains collected in step (c) and identifying a candidate antigen-binding domain, wherein the method does not comprise amplifying nucleic acids that encode the antigen-binding domains collected in step (b) between step (b) and step (c).

In the above method, the number of steps of contacting antigen-binding domains with antigens is not particularly limited. In some embodiments, the method of screening of the present invention may comprise three or more contacting steps when the number of the antigens of interest is two or more. In further embodiments, the method of screening of the present invention may comprise two or more steps of contacting antigen-binding domains with each of one or more of the antigens of interest. In this case, the antigen-binding domains can be contacted with each antigen in an arbitrary order. For example, the antigen-binding domains may be contacted with each antigen twice or more consecutively, or may be first contacted with one antigen once or more times and then contacted with other antigen(s) before being contacted with the same antigen again. Even when the method of screening of the present invention comprises three or more steps of contacting the antigen-binding domains with the antigens, the method does not comprise amplifying nucleic acids that encode the collected antigen-binding domains between any consecutive two of the contacting steps.

In some embodiments, the antigen-binding domains of the present invention are fusion polypeptides formed by fusing antigen-binding domains with scaffolds to cross-link the antigen-binding domains with the nucleic acids that encode the antigen-binding domains.

In some embodiments, the scaffolds of the present invention are bacteriophages. In some embodiments, the scaffolds of the present invention are ribosomes, RepA proteins or DNA puromycin linkers.

In some embodiments, elution is performed in steps (b) and (c) above using an eluting solution that is an acid solution, a base solution, DTT, or IdeS.

In some embodiments, the eluting solution used in steps (b) and (c) above of the present invention is EDTA or IdeS.

In some embodiments, a method of screening for an antigen-binding domain which binds to at least two or more different antigens of interest of the present invention comprises;

(a) providing a library comprising a plurality of antigen-binding domains, (b) contacting the library provided in step (a) with a first antigen of interest and collecting antigen-binding domains bound to the first antigen, (b)' translating nucleic acids that encode the antigen-binding domains collected in step (b), (c) contacting the antigen-binding domains collected in step (b) with a second antigen of interest and collecting antigen-binding domains bound to the second antigen, and (d) amplifying genes which encode the antigen binding domains collected in step (c) and identifying a candidate antigen-binding domain, wherein the method does not comprise amplifying nucleic acids that encode the antigen-binding domains collected in step (b) between step (b) and step (c).

In some embodiments, a method for producing an antigen-binding domain which binds to at least two or more different antigens of interest of the present invention comprises;

(a) providing a library comprising a plurality of antigen-binding domains, (b) contacting the library provided in step (a) with a first antigen of interest and collecting antigen-binding domains bound to the first antigen, (c) contacting the antigen-binding domains collected in step (b) with a second antigen of interest and collecting antigen-binding domains bound to the second antigen, and (d) amplifying genes which encode the antigen binding domains collected in step (c) and identifying a candidate antigen-binding domain, (e) linking the polynucleotide that encodes the candidate antigen-binding domain selected in step (d) with a polynucleotide that encodes a polypeptide comprising an Fc region, (f) culturing a cell introduced with a vector in which the polynucleotide obtained in step (d) above is operably linked, and (g) collecting the antigen-binding molecule from the culture solution of the cell cultured in step (f) above, wherein the method does not comprise amplifying nucleic acids that encode the antigen-binding domains collected in step (b) between step (b) and step (c).

In one embodiment, each of an antigen-binding domain in the library of an antigen-binding domain has at least one amino acid alteration in either one or both of heavy and light variable region(s) each binding to a first antigen (for example, CD3 or CD137) or a second antigen (for example, CD137 if the first antigen is CD3; or CD3 if the first antigen is CD137), wherein each antigen-binding domain in the library differs from any other one in at least one amino acid so altered from each other.

In the present invention, one amino acid alteration may be used alone, or a plurality of amino acid alterations may be used in combination.

In the case of using a plurality of amino acid alterations in combination, the number of the alterations to be combined is not particularly limited and is, for example, 2 or more and 30 or less, preferably 2 or more and 25 or less, 2 or more and 22 or less, 2 or more and 20 or less, 2 or more and 15 or less, 2 or more and 10 or less, 2 or more and 5 or less, or 2 or more and 3 or less.

The plurality of amino acid alterations to be combined may be added to only the antibody heavy chain variable domain or light chain variable domain or may be appropriately distributed to both of the heavy chain variable domain and the light chain variable domain.

As already described in the above, examples of the region preferred for the amino acid alteration include solvent-exposed regions and loops in the variable region. Among others, CDR1. CDR2, CDR3. FR3, and loops are preferred. Specifically. Kabat numbering positions 31 to 35, 50 to 65, 71 to 74, and 95 to 102 in the H chain variable region and Kabat numbering positions 24 to 34, 50 to 56, and 89 to 97 in the L chain variable region are preferred. Kabat numbering positions 31, 52a to 61, 71 to 74, and 97 to 101 in the H chain variable region and Kabat numbering positions 24 to 34, 51 to 56, and 89 to 96 in the L chain variable region are more preferred.

The alteration of an amino acid residue also include: the random alteration of amino acids in the region mentioned above in the antibody variable region binding to the first antigen (for example, CD3 or CD137) or the second antigen (for example, CD137 if the first antigen is CD3; or CD3 if the first antigen is CD137); and the insertion of a peptide previously known to have binding activity against the first antigen (for example, CD3 or CD137) or the second antigen (for example, CD137 if the first antigen is CD3; or CD3 if the first antigen is CD137), to the region mentioned above. The antigen-binding molecule of the present invention can be obtained by selecting a variable region that is capable of binding to the first antigen (for example, CD3 or CD137) and the second antigen (for example, CD137 if the first antigen is CD3, or CD3 if the first antigen is CD137), but cannot bind to these antigens at the same time, from among the antigen-binding molecules thus altered.

Whether the variable region is capable of binding to the first antigen (for example, CD3 or CD137) and the second antigen (for example, CD137 if the first antigen is CD3; or CD3 if the first antigen is CD137), but cannot bind to these antigens at the same time, and further, whether the variable region is capable of binding to both the first antigen (for example, CD3 or CD137) and the second antigen (for example, CD137 if the first antigen is CD3; or CD3 if the first antigen is CD137) at the same time when any one of the first antigen (for example, CD3 or CD137) and the second antigen (for example, CD137 if the first antigen is CD3; or CD3 if the first antigen is CD137) resides on a cell and the other antigen exists alone, both of the antigens each exist alone, or both of the antigens reside on the same cell, but cannot bind to these antigens each expressed on a different cell, at the same time, can also be confirmed according to the method mentioned above.

In one aspect, the instant application also provides a method for producing an antigen-binding molecule of the present invention. A method comprises, for example:

(a) providing at least;

(i) a nucleic acid encoding a polypeptide comprising a heavy chain variable (VH) region of a first antigen-binding domain, which may optionally further comprises a heavy chain constant region (e.g., CH1; CH1 and hinge; CH1, hinge and CH2; CH1, hinge. CH2 and CH3);

(ii) a nucleic acid encoding a polypeptide comprising a light chain variable (VL) region of a first antigen-binding domain, which may optionally further comprises a light chain constant (CL) region;

(iii) a nucleic acid encoding a polypeptide comprising a heavy chain variable (VH) region of a second antigen-binding domain, which may optionally further comprises a heavy chain constant region (e.g., CH1; CH1 and hinge; CH1, hinge and CH2; CH1, hinge, CH2 and CH3); and (iv) a nucleic acid encoding a polypeptide comprising a light chain variable (VL) region of a second antigen-binding domain, which may optionally further comprises a light chain constant (CL) region;

(b) introducing the nucleic acids produced in (a) into a host cell;

(c) culturing the host cell such that the two polypeptides are expressed; and (d) collecting the antigen-binding molecule from the culture solution of the cell cultured in step (c).

In some embodiments, the antigen-binding molecule so produced comprises the first antigen-binding domain and the second antigen-binding domain which are linked with each other via at least one bond. The at least one bond to link the first antigen-binding domain and the second antigen-binding domain are introduced into any one or more of the followings;

(i) between a CH1 region of an antibody heavy chain constant of the first antigen-binding domain and a CH1 region of an antibody heavy chain constant of the second antigen-binding domain;

(ii) between a hinge region of an antibody heavy chain of the first antigen-binding domain and a hinge region of an antibody heavy chain of the second antigen-binding domain;

(iii) between a light chain constant (CL) region of the first antigen-binding domain and a light chain constant (CL) region of the second antigen-binding domain;

(iv) between a CH1 region of an antibody heavy chain constant of the first antigen-binding domain and a light chain constant (CL) region of the second antigen-binding domain;

(v) between a light chain constant (CL) region of the first antigen-binding domain and a CH1 region of an antibody heavy chain constant of the second antigen-binding domain; and/or (vi) between a heavy chain variable (VH) region of the first antigen-binding domain and a heavy chain variable (VH) region of the second antigen-binding domain.

In some embodiments, the above bond to link the first antigen-binding domain and the second antigen-binding domain can created by, for example, introducing at least one amino acid alteration (e.g., substitution to cysteine, or lysine) into each of the polypeptide of the above (i) to (vi).

In one aspect, the instant application also provides a method for producing an antigen-binding molecule of the present invention. A method comprises, for example;

(a) providing at least;

(i) a nucleic acid encoding a polypeptide comprising a heavy chain variable (VH) region of a third antigen-binding domain, which may optionally further comprises a heavy chain constant region (e.g., CH1), and a heavy chain variable (VH) region of a first antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a light chain variable (VL) region of a third antigen-binding domain, which may optionally further comprises a light chain constant (CL) region;

(iii) a nucleic acid encoding a polypeptide comprising a light chain variable (VL) region of a first antigen-binding domain, which may optionally further comprises a light chain constant (CL) region;

(iv) a nucleic acid encoding a polypeptide comprising a heavy chain variable (VH) region of a second antigen-binding domain, which may optionally further comprises a heavy chain constant region (e.g., CH1; CH1 and hinge; CH1, hinge and CH2; CH1, hinge. CH2 and CH3); and (v) a nucleic acid encoding a polypeptide comprising a light chain variable (VL) region of a second antigen-binding domain, which may optionally further comprises a light chain constant (CL) region, (b) introducing the nucleic acids produced in (a) into a host cell;

(c) culturing the host cell such that the two polypeptides are expressed; and (d) collecting the antigen-binding molecule from the culture solution of the cell cultured in step (c).

In some embodiments, the antigen-binding molecule so produced comprises the first antigen-binding domain and the second antigen-binding domain which are linked with each other via at least one bond. The at least one bond to link the first antigen-binding domain and the second antigen-binding domain are introduced into any one or more of the followings;

(i) between a CH1 region of an antibody heavy chain constant of the first antigen-binding domain and a CH1 region of an antibody heavy chain constant of the second antigen-binding domain;

(ii) between a hinge region of an antibody heavy chain of the first antigen-binding domain and a hinge region of an antibody heavy chain of the second antigen-binding domain;

(iii) between a light chain constant (CL) region of the first antigen-binding domain and a light chain constant (CL) region of the second antigen-binding domain;

(iv) between a CH1 region of an antibody heavy chain constant of the first antigen-binding domain and a light chain constant (CL) region of the second antigen-binding domain;

(v) between a light chain constant (CL) region of the first antigen-binding domain and a CH1 region of an antibody heavy chain constant of the second antigen-binding domain; and/or (vi) between a heavy chain variable (VH) region of the first antigen-binding domain and a heavy chain variable (VH) region of the second antigen-binding domain.

In some embodiments, the above bond to link the first antigen-binding domain and the second antigen-binding domain can created by, for example, introducing at least one amino acid alteration (e.g., substitution to cysteine, or lysine) into each of the polypeptide of the above (i) to (vi).

In one aspect, the instant application also provides a method for producing an antigen-binding molecule of the present invention. A method comprises, for example;

(a) providing at least;

(i) a nucleic acid encoding a polypeptide comprising a heavy chain variable (VH) region of a third antigen-binding domain, which may optionally further comprises a heavy chain constant region (e.g., CH1), and a heavy chain variable (VH) region of a second antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a light chain variable (VL) region of a third antigen-binding domain, which may optionally further comprises a light chain constant (CL) region;

(iii) a nucleic acid encoding a polypeptide comprising a light chain variable (VL) region of a second antigen-binding domain, which may optionally further comprises a light chain constant (CL) region; and (iv) a nucleic acid encoding a polypeptide comprising a heavy chain variable (VH) region of a first antigen-binding domain, which may optionally further comprises a heavy chain constant region (e.g, CH1; CH1 and hinge; CH1, hinge and CH2; CH1, hinge, CH2 and CH3);

(v) a nucleic acid encoding a polypeptide comprising a light chain variable (VL) region of a first antigen-binding domain, which may optionally further comprises a light chain constant (CL) region;

(b) introducing the nucleic acids produced in (a) into a host cell;

(c) culturing the host cell such that the two polypeptides are expressed; and (d) collecting the antigen-binding molecule from the culture solution of the cell cultured in step (c).

In some embodiments, the antigen-binding molecule so produced comprises the first antigen-binding domain and the second antigen-binding domain which are linked with each other via at least one bond. The at least one bond to link the first antigen-binding domain and the second antigen-binding domain are introduced into any one or more of the followings;

(i) between a CH1 region of an antibody heavy chain constant of the first antigen-binding domain and a CH1 region of an antibody heavy chain constant of the second antigen-binding domain;

(ii) between a hinge region of an antibody heavy chain of the first antigen-binding domain and a hinge region of an antibody heavy chain of the second antigen-binding domain;

(iii) between a light chain constant (CL) region of the first antigen-binding domain and a light chain constant (CL) region of the second antigen-binding domain;

(iv) between a CH1 region of an antibody heavy chain constant of the first antigen-binding domain and a light chain constant (CL) region of the second antigen-binding domain;

(v) between a light chain constant (CL) region of the first antigen-binding domain and a CH1 region of an antibody heavy chain constant of the second antigen-binding domain; and/or (vi) between a heavy chain variable (VH) region of the first antigen-binding domain and a heavy chain variable (VH) region of the second antigen-binding domain.

In some embodiments, the above bond to link the first antigen-binding domain and the second antigen-binding domain can created by, for example, introducing at least one amino acid alteration (e.g., substitution to cysteine, or lysine) into each of the polypeptide of the above (i) to (vi).

In one aspect, the instant application also provides a method for producing an antigen-binding molecule of the present invention. A method comprises, for example;

(a) providing at least;

(i) a nucleic acid encoding a polypeptide comprising a heavy chain variable (VH) region of a third antigen-binding domain, which may optionally further comprises a heavy chain constant region (e.g, CH1), and a heavy chain variable (VH) region of a first antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a light chain variable (VL) region of a third antigen-binding domain, which may optionally further comprises a light chain constant (CL) region; and (iii) a nucleic acid encoding a polypeptide comprising a light chain variable (VL) region of a first antigen-binding domain, which may optionally further comprises a light chain constant (CL) region;

(b) introducing the nucleic acids produced in (a) into a host cell;

(c) culturing the host cell such that the two polypeptides are expressed;

(d) collecting the antigen-binding molecule from the culture solution of the cell cultured in step (c).

In one aspect, the instant application also provides a method for producing an antigen-binding molecule of the present invention. A method comprises, for example;

(a) providing at least;

(i) a nucleic acid encoding a polypeptide comprising a heavy chain variable (VH) region of a third antigen-binding domain, which may optionally further comprises a heavy chain constant region (e.g., CH1), and a heavy chain variable (VH) region of a second antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a light chain variable (VL) region of a third antigen-binding domain, which may optionally further comprises a light chain constant (CL) region; and (iii) a nucleic acid encoding a polypeptide comprising a light chain variable (VL) region of a second antigen-binding domain, which may optionally further comprises a light chain constant (CL) region;

(b) introducing the nucleic acids produced in (a) into a host cell;

(c) culturing the host cell such that the two polypeptides are expressed, (d) collecting the antigen-binding molecule from the culture solution of the cell cultured in step (c).

In one aspect, the instant application also provides a method for producing an antigen-binding molecule of the present invention. A method comprises, for example;

(a) providing at least;

(i) a nucleic acid encoding a polypeptide comprising a light chain variable (VL) region of a third antigen-binding domain, which may optionally further comprises a light chain constant (CL) region, and a heavy chain variable (VH) region of a first antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a heavy chain variable (VH) region of a third antigen-binding domain, which may optionally further comprises a heavy chain constant region (e.g., CH1; CH1 and hinge);

(iii) a nucleic acid encoding a polypeptide comprising a light chain variable (VL) region of a first antigen-binding domain, which may optionally further comprises a light chain constant (CL) region;

(iv) a nucleic acid encoding a polypeptide comprising a heavy chain variable (VH) region of a second antigen-binding domain, which may optionally further comprises a heavy chain constant region (e.g, CH1; CH1 and hinge; CH1, hinge and CH2; CH1, hinge, CH2 and CH3); and (v) a nucleic acid encoding a polypeptide comprising a light chain variable (VL) region of a second antigen-binding domain, which may optionally further comprises a light chain constant (CL) region;

(b) introducing the nucleic acids produced in (a) into a host cell;

(c) culturing the host cell such that the two polypeptides are expressed; and (d) collecting the antigen-binding molecule from the culture solution of the cell cultured in step (c).

In some embodiments, the antigen-binding molecule so produced comprises the first antigen-binding domain and the second antigen-binding domain which are linked with each other via at least one bond. The at least one bond to link the first antigen-binding domain and the second antigen-binding domain are introduced into any one or more of the followings;

(i) between a CH1 region of an antibody heavy chain constant of the first antigen-binding domain and a CH1 region of an antibody heavy chain constant of the second antigen-binding domain;

(ii) between a hinge region of an antibody heavy chain of the first antigen-binding domain and a hinge region of an antibody heavy chain of the second antigen-binding domain;

(iii) between a light chain constant (CL) region of the first antigen-binding domain and a light chain constant (CL) region of the second antigen-binding domain;

(iv) between a CH1 region of an antibody heavy chain constant of the first antigen-binding domain and a light chain constant (CL) region of the second antigen-binding domain;

(v) between a light chain constant (CL) region of the first antigen-binding domain and a CH1 region of an antibody heavy chain constant of the second antigen-binding domain; and/or (vi) between a heavy chain variable (VH) region of the first antigen-binding domain and a heavy chain variable (VH) region of the second antigen-binding domain.

In some embodiments, the above bond to link the first antigen-binding domain and the second antigen-binding domain can created by, for example, introducing at least one amino acid alteration (e.g., substitution to cysteine, or lysine) into each of the polypeptide of the above (i) to (vi).

In one aspect, the instant application also provides a method for producing an antigen-binding molecule of the present invention. A method comprises, for example;

(a) providing at least;

(1) a nucleic acid encoding a polypeptide comprising a light chain variable (VL) region of a third antigen-binding domain, which may optionally further comprises a light chain constant (CL) region, and a heavy chain variable (VH) region of a second antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a heavy chain variable (VH) region of a third antigen-binding domain, which may optionally further comprises a heavy chain constant region (e.g, CH1; CH1 and hinge);

(iii) a nucleic acid encoding a polypeptide comprising a light chain variable (VL) region of a second antigen-binding domain, which may optionally further comprises a light chain constant (CL) region; and (iv) a nucleic acid encoding a polypeptide comprising a heavy chain variable (VH) region of a first antigen-binding domain, which may optionally further comprises a heavy chain constant region (e.g., CH1; CH1 and hinge; CH1, hinge and CH2; CH1, hinge. CH2 and CH3);

(v) a nucleic acid encoding a polypeptide comprising a light chain variable (VL) region of a first antigen-binding domain, which may optionally further comprises a light chain constant (CL) region;

(b) introducing the nucleic acids produced in (a) into a host cell, (c) culturing the host cell such that the two polypeptides are expressed; and (d) collecting the antigen-binding molecule from the culture solution of the cell cultured in step (c).

In some embodiments, the antigen-binding molecule so produced comprises the first antigen-binding domain and the second antigen-binding domain which are linked with each other via at least one bond. The at least one bond to link the first antigen-binding domain and the second antigen-binding domain are introduced into any one or more of the followings;

(i) between a CH1 region of an antibody heavy chain constant of the first antigen-binding domain and a CH1 region of an antibody heavy chain constant of the second antigen-binding domain;

(ii) between a hinge region of an antibody heavy chain of the first antigen-binding domain and a hinge region of an antibody heavy chain of the second antigen-binding domain;

(iii) between a light chain constant (CL) region of the first antigen-binding domain and a light chain constant (CL) region of the second antigen-binding domain;

(iv) between a CH1 region of an antibody heavy chain constant of the first antigen-binding domain and a light chain constant (CL) region of the second antigen-binding domain;

(v) between a light chain constant (CL) region of the first antigen-binding domain and a CH1 region of an antibody heavy chain constant of the second antigen-binding domain; and/or (vi) between a heavy chain variable (VH) region of the first antigen-binding domain and a heavy chain variable (VH) region of the second antigen-binding domain.

In some embodiments, the above bond to link the first antigen-binding domain and the second antigen-binding domain can created by, for example, introducing at least one amino acid alteration (e.g., substitution to cysteine, or lysine) into each of the polypeptide of the above (i) to (vi).

In one aspect, the instant application also provides a method for producing an antigen-binding molecule of the present invention. A method comprises, for example;

(a) providing at least;

(i) a nucleic acid encoding a polypeptide comprising a light chain variable (VL) region of a third antigen-binding domain, which may optionally further comprises a light chain constant (CL) region, and a heavy chain variable (VH) region of a first antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a heavy chain variable (VH) region of a third antigen-binding domain, which may optionally further comprises a heavy chain constant region (e.g., CH1; CH1 and hinge); and (iii) a nucleic acid encoding a polypeptide comprising a light chain variable (VL) region of a first antigen-binding domain, which may optionally further comprises a light chain constant (CL) region;

(b) introducing the nucleic acids produced in (a) into a host cell;

(c) culturing the host cell such that the two polypeptides are expressed, (d) collecting the antigen-binding molecule from the culture solution of the cell cultured in step (c).

In one aspect, the instant application also provides a method for producing an antigen-binding molecule of the present invention. A method comprises, for example;

(a) providing at least;

(i) a nucleic acid encoding a polypeptide comprising a light chain variable (VL) region of a third antigen-binding domain, which may optionally further comprises a light chain constant (CL) region, and a heavy chain variable (VH) region of a second antigen-binding domain, which may optionally further comprises a heavy chain constant region (e.g., CH1; CH1 and hinge; CH1, hinge and CH2; CH1, hinge, CH2 and CH3);

(ii) a nucleic acid encoding a polypeptide comprising a heavy chain variable (VH) region of a third antigen-binding domain, which may optionally further comprises a heavy chain constant region (e.g., CH1. CH1 and hinge); and (iii) a nucleic acid encoding a polypeptide comprising a light chain variable (VL) region of a second antigen-binding domain, which may optionally further comprises a light chain constant (CL) region;

(b) introducing the nucleic acids produced in (a) into a host cell;

(c) culturing the host cell such that the two polypeptides are expressed;

(d) collecting the antigen-binding molecule from the culture solution of the cell cultured in step (c).

In some embodiments, an antigen-binding molecule of the present invention is an antigen-binding molecule prepared by the method described above.

In one aspect, the method of screening of the present invention makes it possible to acquire an antigen-binding domain which binds to at least two or more different antigens of interest more efficiently.

In the instant application, the "library" refers to a plurality of antigen-binding molecules, a plurality of antigen-binding domains, a plurality of fusion polypeptides comprising the antigen-binding molecules, a plurality of fusion polypeptides comprising the antigen-binding domains, or a plurality of nucleic acids or polynucleotides encoding these thereof. The plurality of antigen-binding molecules, a plurality of antigen-binding domains, or the plurality of fusion poly peptides comprising the antigen-binding molecules, or a plurality of fusion polypeptides comprising the antigen-binding domains, included in the library are antigen-binding molecules, antigen-binding domains, or fusion polypeptides differing in sequence from each other, not having single sequences.

In some embodiments, the library of the present invention is a design library. In further embodiments, the design library is a design library as disclosed in WO2016/076345.

In one embodiment of the present invention, a fusion polypeptide of the antigen-binding molecule or antigen-binding domain of the present invention and a heterologous polypeptide can be prepared. In one embodiment, the fusion polypeptide can comprise the antigen-binding molecule or antigen-binding domain of the present invention fused with at least a portion of a viral coat protein selected from the group consisting of, for example, viral coat proteins pIII, pVIII, pVII, pIX. Soc, Hoc, gpD, and pVI, and variants thereof.

In one embodiment, the present invention provides a library consisting essentially of a plurality of fusion polypeptides differing in sequence from each other, the fusion polypeptides each comprising any of these antigen-binding molecules or antigen-binding domains and a heterologous polypeptide. Specifically, the present invention provides a library consisting essentially of a plurality of fusion polypeptides differing in sequence from each other, the fusion polypeptides each comprising any of these antigen-binding molecules or antigen-binding domains fused with at least a portion of a viral coat protein selected from the group consisting of, for example, viral coat proteins pIII, pVIII, pVII, pIX. Soc, Hoc, gpD, and pVI, and variants thereof. The antigen-binding molecule or antigen-binding domains of the present invention may further comprise a dimerization domain. In one embodiment, the dimerization domain can be located between the antibody heavy chain or light chain variable region and at least a portion of the viral coat protein. This dimerization domain may comprise at least one dimerization sequence and/or a sequence comprising one or more cysteine residues. This dimerization domain can be preferably linked to the C terminus of the heavy chain variable region or constant region. The dimerization domain can assume various structures, depending on whether the antibody variable region is prepared as a fusion polypeptide component with the viral coat protein component (an amber stop codon following the dimerization domain is absent) or depending on whether the antibody variable region is prepared predominantly without comprising the viral coat protein component (e.g., an amber stop codon following the dimerization domain is present). When the antibody variable region is prepared predominantly as a fusion polypeptide with the viral coat protein component, bivalent display is brought about by one or more disulfide bonds and/or a single dimerization sequence.

The term "differing in sequence from each other" in a plurality of antigen-binding molecules or antigen-binding domains differing in sequence from each other as described herein means that the individual antigen-binding molecules or antigen-binding domains in the library have distinct sequences. Specifically, the number of the distinct sequences in the library reflects the number of independent clones differing in sequences in the library and may also be referred to as a "library size". The library size of a usual phage display library is 106 to 1012 and can be expanded to 1014 by the application of a technique known in the art such as a ribosome display method. The actual number of phage particles for use in panning selection for the phage library, however, is usually 10 to 10.000 times larger than the library size. This excessive multiple, also called the "number of equivalents of the library", represents that 10 to 10,000 individual clones may have the same amino acid sequence. Accordingly, the term "differing in sequence from each other" described in the present invention means that the individual antigen-binding molecules in the library excluding the number of equivalents of the library have distinct sequences and more specifically means that the library has 106 to 1014, preferably 107 to 1012, more preferably 108 to 1011, particularly preferably 108 to 1010 antigen-binding molecules or antigen-binding domains differing in sequence from each other.

The "phage display" as described herein refers to an approach by which variant polypeptides are displayed as fusion proteins with at least a portion of coat proteins on the particle surface of phages, for example, filamentous phages. The phage display is useful because a large library of randomized protein variants can be rapidly and efficiently screened for a sequence binding to a target antigen with high affinity. The display of peptide and protein libraries on the phages has been used for screening millions of polypeptides for ones with specific binding properties. A polyvalent phage display method has been used for displaying small random peptides and small proteins through fusion with filamentous phage gene III or gene VIII (Wells and Lowman, Curr. Opin. Struct. Biol. (1992) 3, 355-362; and references cited therein). Monovalent phage display involves fusing a protein or peptide library to gene III or a portion thereof, and expressing fusion proteins at low levels in the presence of wild-type gene III protein so that each phage particle displays one copy or none of the fusion proteins. The monovalent phages have a lower avidity effect than that of the polyvalent phages and are therefore screened on the basis of endogenous ligand affinity using phagemid vectors, which simplify DNA manipulation (Lowman and Wells. Methods: A Companion to Methods in Enzymology (1991) 3, 205-216).

The "phagemid" refers to a plasmid vector having a bacterial replication origin, for example. ColE1, and a copy of an intergenic region of a bacteriophage. A phagemid derived from any bacteriophage known in the art, for example, a filamentous bacteriophage or a lambdoid bacteriophage, can be appropriately used. Usually, the plasmid also contains a selective marker for antibiotic resistance. DNA fragments cloned into these vectors can grow as plasmids. When cells harboring these vectors possess all genes necessary for the production of phage particles, the replication pattern of plasmids is shifted to rolling circle replication to form copies of one plasmid DNA strand and package phage particles. The phagemid can form infectious or non-infectious phage particles. This term includes a phagemid comprising a phage coat protein gene or a fragment thereof bound with a heterologous polypeptide gene by gene fusion such that the heterologous polypeptide is displayed on the surface of the phage particle. The term "phage vector" means a double-stranded replicative bacteriophage that comprises a heterologous gene and is capable of replicating. The phage vector has a phage replication origin that permits phage replication and phage particle formation. The phage is preferably a filamentous bacteriophage, for example, an M13, f1, fd, or Pf3 phage or a derivative thereof, or a lambdoid phage, for example, lambda, 21, phi80, phi81, 82, 424, 434, or any other phage or a derivative thereof.

The term "coat protein" refers to a protein, at least a portion of which is present on the surface of a viral particle. From a functional standpoint, the coat protein is an arbitrary protein that binds to viral particles in the course of construction of viruses in host cells and remains bound therewith until viral infection of other host cells. The coat protein may be a major coat protein or may be a minor coat protein. The minor coat protein is usually a coat protein present in viral capsid at preferably at least approximately 5, more preferably at least approximately 7, further preferably at least approximately 10 or more protein copies per virion. The major coat protein can be present at tens, hundreds, or thousands of copies per virion. Examples of the major coat protein include filamentous phage p8 protein.

The "ribosome display" as described herein refers to an approach by which variant polypeptides are displayed on the ribosome (Nat. Methods 2007 March; 4 (3): 269-79. Nat. Biotechnol. 2000 December; 18 (12): 1287-92, Methods Mol. Biol. 2004; 248:177-89). Preferably, ribosome display methods require that the nucleic acid encoding the variant polypeptide has the appropriate ribosome stalling sequence like *Eschericha coli*, secM (J. Mol. Biol. 2007 Sep. 14; 372 (2): 513-24) or does not have stop codon. Preferably, the nucleic acid encoding variant polypeptide also has a spacer sequence. As used herein the term "spacer sequence" means a series of nucleic acids that encode a peptide that is fused to the variant polypeptide to make the variant polypeptide go through the ribosomal tunnel after translation and which allows the variant polypeptides to express its function. Any of the in vitro translation systems can be used to ribosome display, e.g., *Eschericha coli*. S30 system, PUREsystem, Rabbit reticulocyte lysate system or wheat germ cell free translation system.

The term "oligonucleotide" refers to a short single- or double-stranded polydeoxynucleotide that is chemically synthesized by a method known in the art (e.g., phosphotriester, phosphite, or phosphoramidite chemistry using a solid-phase approach such as an approach described in EP266032; or a method via deoxynucleotide H-phosphonate intermediates described in Froeshler et al., Nucl. Acids. Res. (1986) 14, 5399-5407). Other methods for oligonucleotide synthesis include the polymerase chain reaction described below and other autoprimer methods and oligonucleotide syntheses on solid supports. All of these methods are described in Engels et al., Agnew. Chem. Int. Ed. Engl. (1989) 28, 716-734. These methods are used if the whole nucleic acid sequence of the gene is known or if a nucleic acid sequence complementary to the coding strand is available. Alternatively, a possible nucleic acid sequence may be appropriately predicted using known and preferred residues encoding each amino acid residue, if the target amino acid sequence is known. The oligonucleotide can be purified using polyacrylamide gels or molecular sizing columns or by precipitation.

The terms "amplification of nucleic acids" refers to an experimental procedure to increase the mole number of nucleic acids. As a non-limiting embodiment, nucleic acids include single-stranded RNA (ssRNA), double-stranded DNA (dsDNA) or single-stranded DNA (ssDNA) As a non-limiting embodiment, PCR (polymerase chain reaction) method is used generically as a method to amplify nucleic acids although any methods which can amplify nucleic acids can be used. Alternatively, nucleic acids can be amplified in host cells when the nucleic acid vector was introduced into those host cells. As a non-limiting embodiment, electroporation, heat shock, infection of phages or viruses which have the vector, or chemical reagents can be used to introduce nucleic acids into cells. Alternatively, transcription of DNA, or reverse transcription of mRNA and then transcription of it can also amplify nucleic acids. As a non-limiting embodiment, introduction of phagemid vectors into *Escherichia coli*, is generically used to amplify nucleic acids encoding binding domains, but PCR is also able to be used in phage display technique. In ribosome display, cDNA display, mRNA display and CIS display. PCR method or transcription is generically used to amplify nucleic acids.

The terms "fusion protein" and "fusion polypeptide" refer to a polypeptide having two segments linked to each other. These segments in the polypeptide differ in character. This character may be, for example, a biological property such as in vitro or in vivo activity. Alternatively, this character may be a single chemical or physical property, for example, binding to a target antigen or catalysis of reaction. These two segments may be linked either directly through a single peptide bond or via a peptide linker containing one or more amino acid residues. Usually, these two segments and the linker are located in the same reading frame. Preferably, the two segments of the polypeptide are obtained from heterologous or different polypeptides.

The terms “scaffold” in “fusion polypeptides formed by fusing antigen-binding domains with scaffolds” refer to a molecule which cross-link the antigen-biding domain with the nucleic acids that encode the antigen-binding domain. As a non-limiting embodiment, phage coat protein in phage display, ribosome in ribosome display, puromycin in mRNA or cDNA display, RepA protein in CIS display, virus coat protein in virus display, mammalian cell membrane anchoring protein in mammalian cell display, yeast cell membrane anchoring protein in yeast display, bacterial cell membrane anchoring protein in bacteria display or *E. coli* display, etc, can be used as scaffold in each display methodology.

In the present invention, the term “one or more amino acids” is not limited to a particular number of amino acids and may be 2 or more types of amino acids, 5 or more types of amino acids, 10 or more types of amino acids, 15 or more types of amino acids, or 20 types of amino acids.

As for fusion polypeptide display, the fusion polypeptide of the variable region of the antigen-binding molecule or antigen-binding domain can be displayed in various forms on the surface of cells, viruses, ribosomes, DNAs, RNAs or phagemid particles. These forms include single-chain Fv fragments (scFvs). F(ab) fragments, and multivalent forms of these fragments. The multivalent forms are preferably ScFv, Fab, and F(ab') dimers, which are referred to as (ScFv) 2. F(ab)2, and F(ab')2, respectively, herein. The display of the multivalent forms is preferred, probably in part because the displayed multivalent forms usually permit identification of low-affinity clones and/or have a plurality of antigen-binding sites that permit more efficient selection of rare clones in the course of selection.

Methods for displaying fusion polypeptides comprising antibody fragments on the surface of bacteriophages are known in the art and described in, for example, WO1992001047 and the present specification. Other related methods are described in WO1992020791, WO1993006213, WO1993011236, and 1993019172. Those skilled in the art can appropriately use these methods. Other public literatures (H.R. Hoogenboom & G. Winter (1992) J. Mol Biol 227, 381-388, WO1993006213, and WO1993011236) disclose the identification of antibodies using artificially rearranged variable region gene repertoires against various antigens displayed on the surface of phages.

In the case of constructing a vector for display in the form of scFv, this vector comprises nucleic acid sequences encoding the light chain variable region and the heavy chain variable region of the antigen-binding molecule or antigen-binding domain. In general, the nucleic acid sequence encoding the heavy chain variable region of the antigen-binding molecule or antigen-binding domain is fused with a nucleic acid sequence encoding a viral coat protein constituent. The nucleic acid sequence encoding the light chain variable region of the antigen-binding molecule or antigen-binding domain is linked to the heavy chain variable region nucleic acid of the antigen-binding molecule or antigen-binding domain through a nucleic acid sequence encoding a peptide linker. The peptide linker generally contains approximately 5 to 15 amino acids. Optionally, an additional sequence encoding, for example, a tag useful in purification or detection, may be fused with 3' end of the nucleic acid sequence encoding the light chain variable region of the antigen-binding molecule or antigen-binding domain or the nucleic acid sequence encoding the heavy chain variable region of the antigen-binding molecule or antigen-binding domain, or both.

In the case of constructing a vector for display in the form of F(ab), this vector comprises nucleic acid sequences encoding the variable regions of the antigen-binding molecule or antigen-binding domain and the constant regions of the antigen-binding molecule. The nucleic acid sequence encoding the light chain variable region is fused with the nucleic acid sequence encoding the light chain constant region. The nucleic acid sequence encoding the heavy chain variable region of the antigen-binding molecule or antigen-binding domain is fused with the nucleic acid sequence encoding the heavy chain constant CH1 region. In general, the nucleic acid sequence encoding the heavy chain variable region and constant region is fused with a nucleic acid sequence encoding the whole or a portion of a viral coat protein. The heavy chain variable region and constant region are preferably expressed as a fusion product with at least a portion of the viral coat protein, while the light chain variable region and constant region are expressed separately from the heavy chain-viral coat fusion protein. The heavy chain and the light chain may be associated with each other through a covalent bond or a non-covalent bond. Optionally, an additional sequence encoding, for example, a polypeptide tag useful in purification or detection, may be fused with 3' end of the nucleic acid sequence encoding the light chain constant region of the antigen-binding molecule or antigen-binding domain, or the nucleic acid sequence encoding the heavy chain constant region of the antigen-binding molecule or antigen-binding domain, or both.

As for vector transfer to host cells, the vectors constructed as described above are transferred to host cells for amplification and/or expression. The vectors can be transferred to host cells by a transformation method known in the art, including electroporation, calcium phosphate precipitation, and the like. When the vectors are infectious particles such as viruses, the vectors themselves invade the host cells. Fusion proteins are displayed on the surface of phage particles by the transfection of host cells with replicable expression vectors having inserts of polynucleotides encoding the fusion proteins and the production of the phage particles by an approach known in the art.

The replicable expression vectors can be transferred to host cells by use of various methods. In a non-limiting embodiment, the vectors can be transferred to the cells by electroporation as described in WO2000106717. The cells are cultured at 37 degrees C., optionally for approximately 6 to 48 hours (or until OD at 600 nm reaches 0.6 to 0.8) in a standard culture medium. Next, the culture medium is centrifuged, and the culture supernatant is removed (e.g., by decantation). At the initial stage of purification, the cell pellet is preferably resuspended in a buffer solution (e.g., 1.0 mM HEPES (pH 7.4)). Next, the suspension is centrifuged again to remove the supernatant. The obtained cell pellet is resuspended in glycerin diluted to, for example, 5 to 20% V/V. The suspension is centrifuged again for the removal of the supernatant to obtain cell pellet. The cell pellet is resuspended in water or diluted glycerin. On the basis of the measured cell density of the resulting suspension, the final cell density is adjusted to a desired density using water or diluted glycerin.

Examples of preferred recipient cells include an *E. coli* strain SS320 capable of responding to electroporation (Sidhu et al., Methods Enzymol. (2000) 328, 333-363). The *E. coli* strain SS320 has been prepared by the coupling of MC1061 cells with XLI-BLUE cells under conditions sufficient for transferring fertility episome (F' plasmid) or XLI-BLUE into the MC1061 cells. The *E. coli* strain SS320 has been deposited with ATCC (10801 University Boulevard, Manassas, Virginia) under deposition No. 98795. Any F' episome that permits phage replication in this strain can be used in the present invention. Appropriate episome may be obtained from strains deposited with ATCC or may be obtained as a commercially available product (TG1, CJ236, CSH18, DHF, ER2738, JM101, JM103, JM105, JM107, JM109, JM110, KS1000, XLI-BLUE, 71-18, etc.)

Use of higher DNA concentrations (approximately 10 times) in electroporation improves transformation frequency and increases the amount of DNAs transforming the host cells. Use of high cell densities also improves the efficiency (approximately 10 times). The increased amount of transferred DNAs can yield a library having greater diversity and a larger number of independent clones differing in sequence. The transformed cells are usually selected on the basis of the presence or absence of growth on a medium containing an antibiotic.

The present invention further provides a nucleic acid encoding the antigen-binding molecule of the present invention. The nucleic acid of the present invention may be in any form such as DNA or RNA.

The present invention further provides a vector comprising the nucleic acid of the present invention. The type of the vector can be appropriately selected by those skilled in the art according to host cells that receive the vector. For example, any of the vectors mentioned above can be used.

The present invention further relates to a host cell transformed with the vector of the present invention. The host cell can be appropriately selected by those skilled in the art. For example, any of the host cells mentioned above can be used.

The present invention also provides a pharmaceutical composition comprising the antigen-binding molecule of the present invention and a pharmaceutically acceptable carrier. The pharmaceutical composition of the present invention can be formulated according to a method known in the art by supplementing the antigen-binding molecule of the present invention with the pharmaceutically acceptable carrier. For example, the pharmaceutical composition can be used in the form of a parenteral injection of an aseptic solution or suspension with water or any other pharmaceutically acceptable solution. For example, the pharmaceutical composition may be formulated with the antigen-binding molecule mixed in a unit dosage form required for generally accepted pharmaceutical practice, in appropriate combination with pharmacologically acceptable carriers or media, specifically, sterilized water, physiological saline, plant oil, an emulsifier, a suspending agent, a surfactant, a stabilizer, a flavoring agent, an excipient, a vehicle, a preservative, a binder, etc. Specific examples of the carrier can include light anhydrous silicic acid, lactose, crystalline cellulose, mannitol, starch, carmellose calcium, carmellose sodium, hydroxypropylcellulose, hydroxypropylmethylcellulose, polyvinyl acetal diethylaminoacetate, polyvinylpyrrolidone, gelatin, medium-chain fatty acid triglyceride, polyoxyethylene hydrogenated castor oil 60, saccharide, carboxymethylcellulose, cornstarch, and inorganic salts. The amount of the active ingredient in such a preparation is determined such that an appropriate dose within the prescribed range can be achieved.

An aseptic composition for injection can be formulated according to conventional pharmaceutical practice using a vehicle such as injectable distilled water. Examples of aqueous solutions for injection include physiological saline, isotonic solutions containing glucose and other adjuvants, for example, D-sorbitol, D-mannose, D-mannitol, and sodium chloride. These solutions may be used in combination with an appropriate solubilizer, for example, an alcohol (specifically, ethanol) or a polyalcohol (e.g., propylene glycol and polyethylene glycol), or a nonionic surfactant, for example, polysorbate 80™ or HCO-50.

Examples of oily solutions include sesame oil and soybean oil. These solutions may be used in combination with benzyl benzoate or benzyl alcohol as a solubilizer. The solutions may be further mixed with a buffer (e.g., a phosphate buffer solution and a sodium acetate buffer solution), a soothing agent (e.g., procaine hydrochloride), a stabilizer (e.g., benzyl alcohol and phenol), and an antioxidant. The injection solutions thus prepared are usually charged into appropriate ampules. The pharmaceutical composition of the present invention is preferably administered parenterally. Specific examples of its dosage forms include injections, intranasal administration agents, transpulmonary administration agents, and percutaneous administration agents. Examples of the injections include intravenous injection, intramuscular injection, intraperitoneal injection, and subcutaneous injection, through which the pharmaceutical composition can be administered systemically or locally.

The administration method can be appropriately selected depending on the age and symptoms of a patient. The dose of a pharmaceutical composition containing a polypeptide or a polynucleotide encoding the polypeptide can be selected within a range of, for example, 0.0001 to 1000 mg/kg of body weight per dose. Alternatively, the dose can be selected within a range of, for example, 0.001 to 100000 mg/body of a patient, though the dose is not necessarily limited to these numeric values. Although the dose and the administration method vary depending on the weight, age, symptoms, etc. of a patient, those skilled in the art can appropriately select the dose and the method.

The present invention also provides a method for treating cancer, comprising the step of administering the antigen-binding molecule of the present invention, the antigen-binding molecule of the present invention for use in the treatment of cancer, use of the antigen-binding molecule of the present invention in the production of a therapeutic agent for cancer, and a process for producing a therapeutic agent for cancer, comprising the step of using the antigen-binding molecule of the present invention.

The three-letter codes and corresponding one-letter codes of amino acids used herein are defined as follows: alanine: Ala and A, arginine: Arg and R, asparagine: Asn and N, aspartic acid: Asp and D, cysteine: Cys and C, glutamine: Gln and Q, glutamic acid: Glu and E, glycine: Gly and G, histidine: His and H, isoleucine: Ile and I, leucine: Leu and L, lysine. Lys and K, methionine: Met and M, phenylalanine: Phe and F, proline: Pro and P, serine: Ser and S, threonine: Thr and T, tryptophan: Trp and W, tyrosine: Tyr and Y, and valine: Val and V.

Those skilled in the art should understand that one of or any combination of two or more of the aspects described herein is also included in the present invention unless a technical contradiction arises on the basis of the technical common sense of those skilled in the art.

All references cited herein are incorporated herein by reference in their entirety.

EXAMPLES

The present invention will be further illustrated with reference to Examples below. However, the present invention is not intended to be limited by Examples below.

[Example 1] Affinity Matured Variant Screening Derived from Parental Dual-Fab H183L072 for Improvement in In Vitro Cytotoxicity on Tumor Cells

1.1. Sequence of Affinity Matured Variants

To increase the binding affinity of Dual-Fab H183L072 (Heavy chain: SEQ ID NO: 123; Light chain: SEQ ID NO: 124 as described in Table 13), more than 1,000 variants were generated using H183L072 as a template. Antibodies are expressed Expi293 (Invitrogen) and purified by Protein A purification followed by gel filtration, if gel filtration is necessary. 11 variants listed in Table 1.1 and 1.2b (SEQ ID NO: 1-64) were selected for further analysis and the binding affinities are evaluated in the Example 1.2.2 at 25 degrees C., and/or 37 degrees C. using Biacore T200 instrument (GE Healthcare) described below.

TABLE 1.1

| Antibody Name | Characterization | VHR name | VLR name | VHR | VHR_CDR1 | VHR_CDR2 |
|---|---|---|---|---|---|---|
| H0888L0581 | Dual variants | dBBDu183H0888 | dBBDu072L0581 | 1 | 12 | 23 |
| H1673L0943 | Dual variants | dBBDu183H1673 | dBBDu072L0943 | 2 | 13 | 24 |
| H1595L0581 | Dual variants | dBBDu183H1595 | dBBDu072L0581 | 3 | 14 | 25 |
| H1571L0581 | Dual variants | dBBDu183H1571 | dBBDu072L0581 | 4 | 15 | 26 |
| H1573L0581 | Dual variants | dBBDu183H1573 | dBBDu072L0581 | 5 | 16 | 27 |
| H1579L0581 | Dual variants | dBBDu183H1579 | dBBDu072L0581 | 6 | 17 | 28 |
| H1643L0581 | Dual variants | dBBDu183H1643 | dBBDu072L0581 | 7 | 18 | 29 |
| H0868L0581 | Dual variants | dBBDu183H0868 | dBBDu072L0581 | 8 | 19 | 30 |
| H1572L0581 | Dual variants | dBBDu183H1572 | dBBDu072L0581 | 9 | 20 | 31 |
| H1647L0581 | Anti-CD137 variant | dBBDu183H1647 | dBBDu072L0581 | 10 | 21 | 32 |
| H0883 | Anti-CD3 variant | dBBDu183H0883 | dBBDu072L | 11 | 22 | 33 |
| H183L072 | Dual parental variants | dBBDu183H | dBBDu072L | 61 | 62 | 63 |

| Antibody Name | VHR_CDR3 | VLR | VLR_CDR1 | VLR_CDR2 | VLR_CDR3 |
|---|---|---|---|---|---|
| H0888L0581 | 34 | 45 | 49 | 53 | 57 |
| H1673L0943 | 35 | 46 | 50 | 54 | 58 |
| H1595L0581 | 36 | 45 | 49 | 53 | 57 |
| H1571L0581 | 37 | 45 | 49 | 53 | 57 |
| H1573L0581 | 38 | 45 | 49 | 53 | 57 |
| H1579L0581 | 39 | 45 | 49 | 53 | 57 |
| H1643L0581 | 40 | 45 | 49 | 53 | 57 |
| H0868L0581 | 41 | 45 | 49 | 53 | 57 |
| H1572L0581 | 42 | 45 | 49 | 53 | 57 |
| H1647L0581 | 43 | 45 | 49 | 53 | 57 |
| H0883 | 44 | 48 | 52 | 56 | 60 |
| H183L072 | 64 | 48 | 52 | 56 | 60 |

TABLE 1.2a

| Antigen name | SEQ List | Amino Acid Sequence |
|---|---|---|
| Human CD3eg linker | 65 | QDGNEEMGGITQTPYKVSISGTTVILTCPQYPGSEILWQHNDKNIGGDED DKNIGSDEDHLSLKEFSELEQSGYYVCYPRGSKPEDANFYLYLRARVGS ADDAKKDAAKKDDAKKDDAKKDGSQSIKGNHLVKVYDYQEDGSVLLTCD AEAKNITWFKDGKMIGFLTEDKKKWNLGSNAKDPRGMYQCKGSQNKSK PLQVYYRMDYKDDDDK |
| Human CD137 ECD | 66 | LQDPCSNCPAGTFCDNNRNQICSPCPPNSFSSAGGQRTCDICRQCKGV FRTRKECSSTSNAECDCTPGFHCLGAGCSMCEQDCKQGQELTKKGCKD CCFGTFNDQKRGICRPWTNCSLDGKSVLVNGTKERDVVCGPSPADLSP GASSVTPPAPAREPGHSPQHHHHHHGGGGSGLNDIFEAQKIEWHE |

TABLE 1.2b

| Variant Name | SEQ List | Amino Acid Sequence |
|---|---|---|
| dBBDu183H0888 | 1 | QVQLVESGGGLVQPGRSLRLSCAASGFKFSNVWMHWVRQA PGKGLEWVAQIKDKWNAYAAYYAPSVKGRFTISRDDSKNSIYL QMNSLKTEDTAVYYCHYIHYASASTLLPAFGIDAWGQGTTVTV SS |
| dBBDu183H1673 | 2 | QVQLVESGGGLVQPGRSLRLSCAASGFVFSNVWFHWVRQA PGKGLEWVAQIKDKWNAYADYYAPSVKERFTISRDDSKNSIYL QMNSLKTEDTAVYYCHYIHYASASTLLPAEGIDAWGQGTTVTV SS |

TABLE 1.2b-continued

| Variant Name | SEQ List | Amino Acid Sequence |
|---|---|---|
| dBBDu183H1595 | 3 | QVQLVESGGGLVQPGRSLRLSCAASGFKFSNTWMHWVRQA PGKGLEWVAQIKDKYNAYAAYYAPSVKGRFTISRDDSKNSIYL QMNSLKTEDTAVYYCHYIHYASASTLLPAFGVDAWGQGTTVT VSS |
| dBBDu183H1571 | 4 | QVQLVESGGGLVQPGRSLRLSCAASGFKFSNVWFHWVRQA PGKGLEWVAQIKDKYNAYATYYAPSVKGRFTISRDDSKNSIYL QMNSLKTEDTAVYYCHYVHYASASTLLPAFGVDAWGQGTTVT VSS |
| dBBDu183H1573 | 5 | QVQLVESGGGLVQPGRSLRLSCAASGFKFSNVWFHWVRQA PGKGLEWVAQIKDYYNAYAAYYAPSVKGRFTISRDDSKNSIYL QMNSLKTEDTAVYYCHYVHYASASTLLPAFGVDAWGQGTTVT VSS |
| dBBDu183H1579 | 6 | QVQLVESGGGLVQPGRSLRLSCAASGFKFSHVVVFHWVRQA PGKGLEWVAQIKDKYNAYAAYYAPSVKGRFTISRDDSKNSIYL QMNSLKTEDTAVYYCHYVHYASASTLLPAFGVDAWGQGTTVT VSS |
| dBBDu183H1643 | 7 | QVQLVESGGGLVQPGRSLRLSCAASGFKFSNVWFHWVRQA PGKGLEWVAQIKDYYNAYAAYYAPSVKGRFTISRDDSKNSIYL QMNSLKTEDTAVYYCHYVHYASASTLLPAEGVDAWGQGTTV TVSS |
| dBBDu183H0868 | 8 | QVQLVESGGGLVQPGRSLRLSCAASGFKFSNVWMHWVRQA PGKGLEWVAQIKDKYNAYAAYYAPSVKGRFTISRDDSKNSIYL QMNSLKTEDTAVYYCHYVHYASASTLLPAFGVDAWGQGTTVT VSS |
| dBBDu183H1572 | 9 | QVQLVESGGGLVQPGRSLRLSCAASGFKFSNVWFHWVRQA PGKGLEWVAQIKDKYNAYAAYYAPSVKGRFTISRDDSKNSIYL QMNSLKTEDTAVYYCHYVHYASASTLLPAEGVDAWGQGTTV TVSS |
| dBBDu183H1647 | 10 | QVQLVESGGGLVQPGRSLRLSCAASGFKFSNTWFHWVRQA PGKGLEWVAQIKDYYNDYAAYYAPSVKGRFTISRDDSKNSIYL QMNSLKTEDTAVYYCHYVHYASASTLLPAEGVDAWGQGTTV TVSS |
| dBBDu183H0883 | 11 | QVQLVESGGGLVQPGRSLRLSCAASGFTFSNAWMHWVRQA PGKGLEWVAQIKDKGNAYAAYYAPSVKGRFTISRDDSKNSIYL QMNSLKTEDTAVYYCRYVHYASASTLLPAFGVDAWGQGTTVT VSS |
| dBBDu183H0888_VHR_CDR1 | 12 | NVWMH |
| dBBDu183H1673_VHR_CDR1 | 13 | NVWFH |
| dBBDu183H1595_VHR_CDR1 | 14 | NTWMH |
| dBBDu183H1571_VHR_CDR1 | 15 | NVWFH |
| dBBDu183H1573_VHR_CDR1 | 16 | NVWFH |
| dBBDu183H1579_VHR_CDR1 | 17 | HVWFH |
| dBBDu183H1643_VHR_CDR1 | 18 | NVWFH |
| dBBDu183H0868_VHR_CDR1 | 19 | NVWMH |
| dBBDu183H1572_VHR_CDR1 | 20 | NVWFH |
| dBBDu183H1647_VHR_CDR1 | 21 | NTWFH |
| dBBDu183H0883_VHR_CDR1 | 22 | NAWMH |
| dBBDu183H0888_VHR_CDR2 | 23 | QIKDKWNAYAAYYAPSVKG |
| dBBDu183H1673_VHR_CDR2 | 24 | QIKDKWNAYADYYAPSVKE |
| dBBDu183H1595_VHR_CDR2 | 25 | QIKDKYNAYAAYYAPSVKG |
| dBBDu183H1571_VHR_CDR2 | 26 | QIKDKYNAYATYYAPSVKG |
| dBBDu183H1573_VHR_CDR2 | 27 | QIKDYYNAYAAYYAPSVKG |

TABLE 1.2b-continued

| Variant Name | SEQ List | Amino Acid Sequence |
|---|---|---|
| dBBDu183H1579_VHR_CDR2 | 28 | QIKDKYNAYAAYYAPSVKG |
| dBBDu183H1643_VHR_CDR2 | 29 | QIKDYYNAYAAYYAPSVKG |
| dBBDu183H0868_VHR_CDR2 | 30 | QIKDKYNAYAAYYAPSVKG |
| dBBDu183H1572_VHR_CDR2 | 31 | QIKDKYNAYAAYYAPSVKG |
| dBBDu183H1647_VHR_CDR2 | 32 | QIKDYYNDYAAYYAPSVKG |
| dBBDu183H0883_VHR_CDR2 | 33 | QIKDKGNAYAAYYAPSVKG |
| dBBDu183H0888_VHR_CDR3 | 34 | IHYASASTLLPAFGIDA |
| dBBDu183H1673_VHR_CDR3 | 35 | IHYASASTLLPAEGIDA |
| dBBDu183H1595_VHR_CDR3 | 36 | IHYASASTLLPAFGVDA |
| dBBDu183H1571_VHR_CDR3 | 37 | VHYASASTLLPAFGVDA |
| dBBDu183H1573_VHR_CDR3 | 38 | VHYASASTLLPAFGVDA |
| dBBDu183H1579_VHR_CDR3 | 39 | VHYASASTLLPAFGVDA |
| dBBDu183H1643_VHR_CDR3 | 40 | VHYASASTLLPAEGVDA |
| dBBDu183H0868_VHR_CDR3 | 41 | VHYASASTLLPAFGVDA |
| dBBDu183H1572_VHR_CDR3 | 42 | VHYASASTLLPAEGVDA |
| dBBDu183H1647_VHR_CDR3 | 43 | VHYASASTLLPAEGVDA |
| dBBDu183H0883_VHR_CDR3 | 44 | VHYASASTLLPAFGVDA |
| dBBDu072L0581 | 45 | DIVMTQSPLSLPVTPGEPASISCQPSQEVVHMNRNTYLHWYQ<br>QKPGQAPRLLIYKVSNRFPGVPDRFSGSGSGTDFTLKISRVE<br>AEDVGVYYCAQGTSHPFTFGQGTKLEIK |
| dBBDu072L0943 | 46 | DIVMTQSPLSLPVTPGEPASISCQPSEEVVHMNRNTYLHWYQ<br>QKPGQAPRLLIYKVSNLFPGVPDRFSGSGSGTDFTLKISRVEA<br>EDVGVYYCAQGTHHPFTFGQGTKLEIK |
| dBBDu072L0918 | 47 | DIVMTQSPLSLPVTPGEPASISCQPSQEVVHMNNVVYLHWYQ<br>QKPGQAPRLLIYKVSNRFPGVPDRFSGSGSGTDFTLKISRVE<br>AEDVGVYYCAQGTSHPFTFGQGTKLEIK |
| dBBDu072L | 48 | DIVMTQSPLSLPVTPGEPASISCQASQELVHMNRNTYLHWYQ<br>QKPGQAPRLLIYKVSNRFPGVPDRFSGSGSGTDFTLKISRVE<br>AEDVGVYYCAQGTSVPFTFGQGTKLEIK |
| dBBDu072L0581_VLR_CDR1 | 49 | QPSQEVVHMNRNTYLH |
| dBBDu072L0943_VLR_CDR1 | 50 | QPSEEVVHMNRNTYLH |
| dBBDu072L0918_VLR_CDR1 | 51 | OPSQEVVHMNNVVYLH |
| dBBDu072L_VLR_CDR1 | 52 | QASQELVHMNRNTYLH |
| dBBDu072L0581_VLR_CDR2 | 53 | KVSNRFP |
| dBBDu072L0943_VLR_CDR2 | 54 | KVSNLFP |
| dBBDu072L0918_VLR_CDR2 | 55 | KVSNRFP |
| dBBDu072L_VLR_CDR2 | 56 | KVSNRFP |
| dBBDu072L0581_VLR_CDR3 | 57 | AQGTSHPFT |
| dBBDu072L0943_VLR_CDR3 | 58 | AQGTHHPFT |
| dBBDu072L0918_VLR_CDR3 | 59 | AQGTSHPFT |
| dBBDu072L_VLR_CDR3 | 60 | AQGTSVPFT |

TABLE 1.2b-continued

| Variant Name | SEQ List | Amino Acid Sequence |
|---|---|---|
| dBBDu183H | 61 | QVQLVESGGGLVQPGRSLRLSCAASGFTFSNAWMHWVRQA PGKGLEVVVAQIKDKGNAYAAYYAPSVKGRFTISRDDSKNSIYL QMNSLKTEDTAVYYCHYVHYASASTVLPAFGVDAWGQGTTV TVSS |
| dBBDu183H_VHR_CDR1 | 62 | NAWMH |
| dBBDu183H_VHR_CDR2 | 63 | QIKDKGNAYAAYYAPSVKG |
| dBBDu183H_VHR_CDR3 | 64 | VHYASASTVLPAFGVDA |

1.2. Binding Kinetics Information of Affinity Matured Variants

1.2.1. Expression and Purification of Human CD3 and CD137

The gamma and epsilon subunits of the human CD3 complex (human CD3eg linker) were linked by a 29-mer linker and a Flag-tag was fused to the C-terminal end of the gamma subunit (Table 1.2a). This construct was expressed transiently using FreeStyle293F cell line (Thermo Fisher). Conditioned media expressing human CD3eg linker was concentrated using a column packed with Q HP resins (GE healthcare) then applied to FLAG-tag affinity chromatography. Fractions containing human CD3eg linker were collected and subsequently subjected to a Superdex 200 gel filtration column (GE healthcare) equilibrated with 1×D-PBS. Fractions containing human CD3eg linker were then pooled and stored at −80 degrees C.

Human CD137 extracellular domain (ECD) (Table 1.2a) with hexahistidine (His-tag) and biotin acceptor peptide (BAP) on its C-terminus was expressed transiently using FreeStyle293F cell line (Thermo Fisher). Conditioned media expressing human CD137 ECD was applied to a HisTrap HP column (GE healthcare) and eluted with buffer containing imidazole (Nacalai). Fractions containing human CD137 ECD were collected and subsequently subjected to a Superdex 200 gel filtration column (GE healthcare) equilibrated with 1× D-PBS. Fractions containing human CD137 ECD were then pooled and stored at −80 degrees C.

1.2.2. Affinity Measurement Towards Human CD3 and CD137

Binding affinity of Dual-Fab antibodies (Dual-Ig) to human CD3 were assessed at 25 degrees C. using Biacore T200 instrument (GE Healthcare). Anti-human Fc (GE Healthcare) was immobilized onto all flow cells of a CM4 sensor chip using amine coupling kit (GE Healthcare). Antibodies were captured onto the anti-Fc sensor surfaces, then recombinant human CD3 or CD137 was injected over the flow cell. All antibodies and analytes were prepared in ACES pH 7.4 containing 20 mM ACES, 150 mM NaCl, 0.05% Tween 20, 0.005% NaN3. Sensor surface was regenerated each cycle with 3M MgCl2. Binding affinity were determined by processing and fitting the data to 1:1 binding model using Biacore T200 Evaluation software, version 2.0 (GE Healthcare). CD137 binding affinity assay was conducted in same condition except assay temperature was set at 37 degrees C. Binding affinity of Dual-Fab antibodies to recombinant human CD3 & CD137 are shown in Table 1.3.

TABLE 1.3

| Antibody Name | CD3 (25° C.) KD (M) | CD137 (37C) KD (M) |
|---|---|---|
| H0888L0581 | 2.02E−08 | 2.08E−07 |
| H1673L0943 | 2.46E−08 | 5.65E−08 |
| H1595L0581 | 5.70E−08 | 1.95E−07 |
| H1571L0581 | 1.23E−07 | 8.50E−08 |
| H1573L0581 | 1.56E−07 | 7.06E−08 |
| H1579L0581 | 2.73E−07 | 2.75E−07 |
| H1643L0581 | 2.88E−07 | 4.79E−08 |
| H0868L0581 | 1.73E−07 | 1.08E−07 |
| H1572L0581 | 2.86E−07 | 5.21E−08 |
| H1647L0581 (CD137) | Below detection | 6.05E−08 |
| H0883 (CD3) | 1.10E−07 | Below detection |
| CD3& (Reference Example 13) | 5.14E−08 | Below detection |

Apart from these 11 variants, Table 1 also included two other variants we identified from the affinity maturation process: clone H883 and H1647L0581. H883 variant retained CD3 binding and CD137 binding is below detection. In addition, variant such as H1647L0581 retained CD137 binding but CD3 binding is shown to be below detection. As such, variant H883 and H1647L0581 can be used in Example 3 described below as predominantly CD3 or CD137 binders respectively.

1.3. Bi-Specific and Tri-Specific Antibody Preparation

Anti-GPC3 (Heavy chain: SEQ ID NO: 496; Light chain: SEQ ID NO: 497) targeting tumor antigen glypican-3, or negative control. Keyhole Limpet Hemocyanin (KLH) (herein termed as Ctrl) antibodies, were used as anti-target binding arms while antibodies described in Example 1.1 and 1.2 were generated using Fab-arm exchange (FAE) according to a method described in (Proc Natl Acad Sci USA. 2013 Mar. 26; 110 (13): 5145-5150). The molecular format of all four antibodies are the same format as a conventional IgG (FIG. 2.1*d*). For example, anti-GPC3/H1643L581 is a tri-specific antibody that is able to bind GPC3, CD3, and CD137. To identify which Dual-Ig tri-specific variants among the 11 variants described Example 1.1 that contributes to improved cytotoxicity attributed to CD137 activity, anti-GPC3/CD3 epsilon, a bi-specific antibody (Reference Example 6) that is able to bind GPC3 and CD3 was included as a control. All antibodies generated comprises a silent Fc with attenuated affinity for Fc gamma receptor.

1.4. Assessment of CD137 Agonistic Activity of Affinity Matured Variants In Vitro To evaluate which antibody variant could result in strong CD137 agonistic activity as a result of affinity maturation, the GloResponse™ NF-kappa B-Luc2/CD137 Jurkat cell line (Promega #CS196004) as effector cells while SK-pca60 cell line (Reference Example 13) which express human GPC3 on the cell membrane was used as target cells. Both $4.0\times10^3$ cells/well SK-pca60 cells (target cells) and $2.0\times10^4$ cells/well NF-kappa B-Luc2/CD137 Jurkat (Effector cells) were added on the each well of white-bottomed, 96-well assay plate (Costar, 3917) at ET ratio of 5. Antibodies were added to each well at 0).5 nM and 5 nM concentration and incubated at 37 degrees Celsius, 5% CO2 at 37 degrees Celsius for 5 hours. The expressed Luciferase was detected with Bio-Glo luciferase assay system (Promega. G7940) according to Manufacturer's instructions. Luminescence (units) was detected using GloMax (registered trademark) Explorer System (Promega #GM3500) and captured values were plotted using Graphpad Prism 7. In FIG. 1.1, antibody variants were divided into plate 1 (FIG. 1.1*a*) and plate 2 (FIG. 1.1*b*) with GPC3/H0868L581 and GPC3/H1643L0581 variant as inter-plate controls. All variants in both plates have detectable CD137 agonistic activity compared to GPC3/CD3 epsilon. Accordingly, GPC3/H1643L581. GPC3/H1571L581 and GPC3/H1573L.581 were the top variants that resulted in stronger CD137 agonistic activity in plate 1 (FIG. 1.1*a*) while GPC3/H1572L581, GPC3/H0868L581 and GPC3/H1595L0581 in plate 2 (FIG. 1.1*b*) that resulted in stronger CD137 agonistic activity whereas variants such as GPC3/H888L581, and GPC3/H1673L581 showed weaker CD137 activity.

1.5. Evaluation of In Vitro Cytotoxicity of Affinity Matured Variants

In order to extend the observations of ranking for these antibody variants, representative strong and weak variants described earlier were subjected to evaluation of cytotoxicity activity on SK-pca60 cells using human peripheral blood mononuclear cells.

1.5.1. Preparation of Frozen Human PBMC

Cryovials containing PBMCs were placed in the water bath at 37 degrees C., to thaw cells. Cells were then dispensed into a 15 mL falcon tube containing 9 mL of media (media used to culture target cells). Cell suspension was then subjected to centrifugation at 1,200 rpm for 5 minutes at room temperature. The supernatant was aspirated gently and fresh warmed medium was added for resuspension and used as the human PBMC solution.

1.5.2. Measurement of TDCC Activity Using Anti-GPC3 Affinity Matured Dual-Ig Tri-Specific Antibodies FIG. 1.2 shows the TDCC activity of anti-GPC3 affinity matured Dual-Ig tri-specific antibodies. Cytotoxic activity was assessed by the rate of cell growth inhibition using xCELLigence Real-Time Cell Analyzer (Roche Diagnostics). SK-pca60 cell line was used as target cells. Target cells were detached from the dish and cells were plated into E-plate 96 (Roche Diagnostics) in aliquots of 100 micro L/well by adjusting the cells to $3.5\times10^3$ cells/well, and measurement of cell growth was initiated using the xCELLigence Real-Time Cell Analyzer, 24 hours later, the plate was removed and 50 micro L of the respective antibodies prepared at each concentration (5 or 10 nM) were added to the plate. After 15 minutes of reaction at room temperature, 50 micro L of the fresh human PBMC solution prepared in (Example 1.5.1) was added in effector: target ratio of 0.5 (i.e. $1.75\times10^3$ cells/well) and measurement of cell growth was resumed using xCELLigence Real-Time Cell Analyzer. The reaction was carried out under the conditions of 5% carbon dioxide gas at 37 degrees C. As CD137 signaling enhances T-cell survival and prevents activation induced cell death, TDCC assay is conducted at a low E:T ratio. And, in some cell lines an extended period of time may be required to observe superior cytotoxicity contributed by CD137 activation. Depending on the cell line, approximately 72 hours or 120 hours after the addition of PBMCs, Cell Growth Inhibition (CGI) rate (%) was determined using the equation below. The Cell Index Value obtained from xCELLigence Real-Time Cell Analyzer used in the calculation was a normalized value where the Cell Index value immediately at the time point before antibody addition was defined as 1.

$$\text{Cell Growth Inhibition rate (\%)}=(A-B)\times100/(A-1)$$

A represents the mean value of Cell Index values in wells without antibody addition (containing only target cells and human PBMCs), and B represents the mean value of the Cell Index values of target wells. The examinations were performed in triplicates.

As shown in FIG. 1.1, affinity matured variants with stronger cytotoxicity than GPC3/CD3 epsilon included GPC3/H1643L581, GPC3/H1571L581 and GPC3/H1595L581 at both concentrations. This suggests that binding to CD137 contributes to improved cytotototoxicity by these variants compared to GPC3/CD3 epsilon. Variants such as GPC3/H0868L581. GPC3/H1572L.581 showed weaker cytotoxicity than GPC3/CD3 epsilon at 5 nM. As such, anti-GPC3/H1643L581 which consistently showed stronger Jurkat activation and cytotoxicity in Skpca60a cell line was selected for further optimization using different antibody formats to improve efficacy.

[Example 2] Cytotoxicity is Improved Using 1+2 Trivalent Format, Monovalent GPC3, Bivalent Dual Fabs and 2Fab Antibodies

2.1. Generation and Sequence of 1+2 Trivalent and 2Fab Antibodies

Target antigen expression in solid tumors are likely to be highly heterogenous and regions of tumors with low antigen expression may not provide sufficient cross-linking of CD3 or CD137. In particular. CD137 receptor clustering is critical for efficient agonistic activity (Trends Biohem Sci. 2002 January; 27 (1) 19-26). We selected endogenous cancer cell lines with lower GPC3 expression than Skpca60 cell line (FIG. 2.3*a*). For analysis of GPC3 expression, 10 micro g/mL of anti-GPC3 antibodies (black solid histogram) or 10 micro g/mL of negative control antibodies (grey filled histogram) were incubated with each cell line for 30 minutes at 4 degrees C., and washed with FACS buffer (2% FBS, 2 mM EDTA in PBS). Goat F(ab')2 anti-Human IgG. Mouse ads-PE (Southern Biotech, Cat. 2043-09) was then added and incubated for 30 minutes at 4 degrees C., and washed with FACS buffer. Data acquisition was performed on an FACS Verse (Becton Dickinson), followed by analysis using the FlowJo software (Tree Star). As shown in FIG. 2.3*a*, endogenous cancer cell lines such as Huh7 and NCI-H446 have much lower GPC3 expression than SK-pca60 transfectant cells (Reference Example 13).

As shown in FIG. 2.3*b*, no significant improvement in efficacy can be observed by GPC3/Dual when compared to GPC3/CD3 epsilon at both 3 nM and 10 nM in Huh7 cell line and SnM and 10 nM in NCI-H446 cell lines respectively. Both cell lines were co-cultured with PBMC. E:T 1 for 72h using xCELLigence performed similarly described in Example 1.5.2. This is in contrast to what was observed in Example 1.1 (FIG. 1.2) where GPC3/Dual was superior to GPC3/CD3 epsilon. It is likely that in SK-pca60 cell line, GPC3 expression is sufficient for cross-linking of CD137 for agonistic activity. Of note, in Huh7 cell line where expression of GPC3 is the lowest, it can be observed that GPC3/Dual shows weaker in vitro efficacy than GPC3/CD3 epsilon (FIG. 2.3*b*). This suggests that CD137 agonistic activity from Dual-Ig is insufficient to improve efficacy and weaker cytotoxicity could be due to weaker CD3 affinity of Dual-Ig clone (Table 1.3). As such, it is important to improve efficacy of Dual-Ig in 1+1 format (FIG. 2.1*d*), especially in tumor cells with low tumor antigen expression.

To improve cytotoxicity through increased CD137 agonistic activity, clustering of CD137 would be critical. The binding to number of CD137 molecules is increased through designing 1+2 trivalent format (FIG. 2.1*a*). Apart from 1+2 format, we also considered 2Fab format (FIG. 2.1*c*). It was previously shown that epitope distance of target on membrane to T cell can determine potency of lysis plausibly due to more efficient cytolytic synapse formation or closer adherence between target and T cell (Cancer Immunol Immunther. 2010 August; 59 (8): 1197-209). The 2Fab format (FIG. 2.1*c*) containing tumor targeting (Fv A) and effector targeting (Fv B) Fab can result in closer proximity and more rigid binding between tumor cells and effector cells compared to conventional IgG type (FIG. 2.1*d*) antibodies analyzed in Example 1. As such, we wanted to investigate if 2Fab format could also improve efficacy of Dual-Ig. Both the 1+2 trivalent and 2Fab antibody were generated by utilizing CrossMab technology, and comprised of a silent Fc with attenuated affinity for Fc gamma receptor. For 1+2 trivalent format (FIG. 2.1*a*), GPC3-Dual/Dual comprising monovalent tumor antigen binding of GPC3, bivalent CD3 and bivalent CD137 binding properties attributed to two Fab containing H1643L581 (FIG. 2.1*a*, 2.2*a* and Table 2.1, 2.2). For 2Fab format, GPC3-Dual comprising monovalent tumor antigen binding of GPC3, monovalent CD3 and monovalent CD137 binding, attributed to one Fab containing H1643L581 for the anti-effector targeting arm (FIG. 2.1*c*, 2.2*c* and Table 2.1, 2.2). All antibodies are expressed by transient expression in Expi293 cells (Invitrogen) and purified according to Example 1.1.

2.2. Cytotoxicity of 1+2 trivalent and 2Fab antibody on GPC3 positive cancer cell lines. To evaluate potency of 1+2 trivalent antibody. TDCC was conducted as described in Example 1.5.2 using 0.6, 2.5 and 10 nM of antibodies.

For comparison of efficacy, conventional IgG format (FIG. 2.1*d*) GPC3/H1643L0581 used in Example 1, referred to as GPC3/Dual, was included in the assay. As shown in FIG. 2.3*c*, 1+2 trivalent GPC3-Dual/Dual showed stronger TDCC activity than GPC3/Dual at 2.5 nM in Huh7 cell line when co-cultured with PBMC at E:T 1 for 120h, 2Fab GPC3/Dual antibody did not show superior TDCC activity when compared to conventional IgG format GPC3/Dual. Similarly in FIG. 2.3*b*, 1+2 trivalent GPC3-Dual/Dual showed stronger TDCC activity in NCI-H446 cancer cells co-cultured with PBMC E:T 1 for 72 hours. However, 2Fab format showed similar activity as 1+2 trivalent GPC3-Dual/Dual.

[Example 3] 1+2 Trivalent Format Results in Antigen-Independent Cytotoxicity by Immune Cells which can be Restricted by Crosslinking the Two Fabs Binding to CD3 and/or CD137

Although 1+2 trivalent antibody format (FIG. 2.1*a*) shows stronger cytotoxicity than 1+1 format (FIG. 2.1*d*), 1+2 trivalent antibodies comprises bivalent CD3 and bivalent CD137 binding. We believed that CD137 and/or CD3-expressing immune cells could be cross-linked to each other in the absence of binding to tumor antigen. GPC3, as depicted in FIG. 3.1. This could result in antigen independent toxicity. As such, we introduced a pair of di-sulphide bond between Dual/Dual Fab by introducing cysteine substitution at various positions (i.e. line technology; Reference Examples 15-17). We believe that this will reduce trans-binding and result predominantly in cis-binding as a result of steric hindrance or distance between 2 Fabs.

3.1. Generation and Sequence of Crosslinked Trivalent Antibodies (Line-Ig)

Trivalent antibodies were generated by utilizing CrossMab and introducing cysteine substitution at various positions (Example 2 and Reference Example 15-17). One pair of di-sulphide bond was introduced at S191C (Kabat numbering) of Dual/Dual Fab. Fc region was Fc gamma R silent and deglycosylated. The target antigen of each Fv region in the trispecific antibodies was shown in Table 2.1. The naming rule of each of binding domain is shown in FIG. 2.2 and the corresponding SEQ ID NOs are shown in Table 2.2 and 2.3. For example, GPC3-Dual/Dual comprises of one anti-GPC3 Fab and two Dual variant Fab H1643L0581 and H1643L0581. In another instance GPC3-CD3/CD3 comprises of one anti-GPC3 Fab and two Dual variant control Fab, H883 and H883. Finally GPC3-Dual/CD137 comprises of one anti-GPC3 Fab, one Dual variant Fab H1643L0581 and one CD137 binding Fab, H1647L0581. All antibodies are expressed as trivalent form by transient expression in Expi293 cells (Invitrogen) and purified according to Example 1.1.

TABLE 2.1

| Name of trivalent Ab | Variant name | Fv A | Fv B | Fv C |
|---|---|---|---|---|
| GPC3-Dual/Dual (1 + 2) | GPC3-H1643L0581/H1643L0581 | Anti-GPC3 | Dual | Dual |
| Ctrl-Dual/Dual (1 + 2) | Ctrl-H1643L0581/H1643L0581 | Ctrl | Dual | Dual |
| **Name of HH linc trivalent Ab** | **Variant name** | **Fv A** | **Fv B** | **Fv C** |
| GPC3-Dual/Dual (linc) | HH linc GPC3-H1643L0581/H1643L0581 | Anti-GPC3 | Dual | Dual |
| GPC3-CD3/CD3 (linc) | HH linc GPC-H0883/H0883 | Anti-GPC3 | Anti-CD3 | Anti-CD3 |
| GPC3-CD137/Dual (linc) | HH linc GPC3-H1647L0581/H1643L0581 | Anti-GPC3 | Anti-CD137 | Dual |
| GPC3-Dual/CD137 (linc) | HH linc GPC3-H1643L0581/H1647L0581 | Anti-GPC3 | Dual | Anti-CD137 |
| Ctrl-Dual/Dual (linc) | HH linc Ctrl-H1643L0581/H1643L0581 | Ctrl | Dual | Dual |

TABLE 2.1-continued

| | | | | |
|---|---|---|---|---|
| Ctrl-CD3/CD3 (linc) | HH linc Ctrl-H0883/H0883 | Ctrl | Anti-CD3 | Anti-CD3 |
| Ctrl-Dual/CD137 (linc) | HH linc Ctrl-H1643L0581/H1647L0581 | Ctrl | Anti-CD137 | Dual |
| Name of HH linc trivalent Ab | Variant name | Fv A | Fv B | |
| GPC3-Dual (2Fab) | GPC3-H1643L0581 | Anti-GPC3 | Dual | |

TABLE 2.2

| Name of trivalent Ab | Variant name | Chain 1 (SEQ ID NO.) | Chain 2 (SEQ ID NO.) |
|---|---|---|---|
| GPC3-Dual/Dual (1 + 2) | GPC3-H1643L0581/H1643L0581 | 67 | 68 |
| Ctrl-Dual/Dual (1 + 2) | Ctrl-H1643L0581/H1643L0581 | 71 | 72 |
| Name of HH linc trivalent Ab | Variant name | Chain 1 (SEQ ID NO.) | Chain 2 (SEQ ID NO.) |
| GPC3-Dual/Dual (linc) | HH linc GPC3-H1643L0581/H1643L0581 | 73 | 68 |
| GPC3-CD3/CD3 (linc) | HH linc GPC-H0883/H0883 | 75 | 68 |
| Name of HH linc trivalent Ab | Variant name | Chain 1 (SEQ ID NO.) | Chain 2 (SEQ ID NO.) |
| GPC3-Dual (2Fab) | GPC3-H1643L0581 | 83 | 68 |
| | Name of trivalent Ab | Chain 3 (SEQ ID NO.) | Chain 4 (SEQ ID NO.) |
| | GPC3-Dual/Dual (1 + 2) | 69 | 70 |
| | Ctrl-Dual/Dual (1 + 2) | 69 | 70 |
| | Name of HH linc trivalent Ab | Chain 3 (SEQ ID NO.) | Chain 4 (SEQ ID NO.) |
| | GPC3-Dual/Dual (linc) | 74 | 70 |
| | GPC3-CD3/CD3 (linc) | 76 | 77 |
| | Name of HH linc trivalent Ab | Chain 3 (SEQ ID NO.) | Chain 4 (SEQ ID NO.) |
| | GPC3-Dual (2Fab) | 84 | 82 |

TABLE 2.3

| SEQ list | Amino Acid Sequence |
|---|---|
| 67 | DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP |
| 68 | QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 69 | QVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP |
| 70 | DIVMTQSPLSLPVTPGEPASISCQPSQEVVHMNRNTYLHWYQQKPGQAPRLLIYKVSNRFPGVPDRFSGSGSGTDFTLKISRVEAEDVGVYYCAQGTSHPFTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC |
| 71 | DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP |

TABLE 2.3-continued

| SEQ list | Amino Acid Sequence |
|---|---|
| 72 | QVQLQQSGPQLVRPGASVKISCKASGYSFTSYWMHWVNQRPGQGLEWIGMIDPSYSETRLNQKFKDKATLTVDKSSSTAYMQLSS<br>PTSEDSAVYYCALYGNYFDYWGQGTTLTVSSASVAAPSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGEC |
| 73 | DIVMTQSPLSLPVTPGEPASISCRSSQPLVHSNRNTYLHWYQQKPGQAPRLLIYKVSNRFSGVPDRFSGSGSGTDFTLKISRVEAEDV<br>GVYYCGQGTQVPYTFGQGTKLEIKSSASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCGGGGSGGGGSQVQLVESGGGLVQPGRSLRLSCAASGFKFSNVWFHW<br>VRQAPGKGLEWVAQIKDYYNAYAAYYAPSVKGRFTISRDDSKNSIYLQMNSLKTEDTAVYYCHYVHYASASTLLPAEGVDAWGQGTT<br>VTVSSASTKGPSVFPLAPSSKSTSGGTAALGCLVEDYFPEPVTVSWNSGALTSGVHTFPAVLQSSGLYSLSSVVTVPSCSLGTQTYICNV<br>NHKPSNTKVDEKVEPKSCDKTHTCPPCPAPELRRGPKVFLFPPKPKDTLMISRTPEVTCVVVDVSHEDPEVKFNWYVDGVEVHNAK<br>TKPREEQYASTYRVVSVLTVLHQDWLNGKEYKCKVSNKALPAPIEKTISKAKGQPREPQVYTLPPCREEMTKNQVSLWCLVKGFYPSD<br>IAVEWESNGQPENNYKTTPPVLDSDGSFFLYSKLTVDKSRWQEGNVFSCSVMHEALHNHYTQKSLSLSP |
| 74 | QVQLVESGGGLVQPGRSLRLSCAASGFKFSNVWFHWVRQAPGKGLEWVAQIKDYYNAYAAYYAPSVKGRFTISRDDSKNSIYLQMN<br>SLKTEDTAVYYCHYVHYASASTLLPAEGVDAWGQGTTVTVSSASTKGPSVFPLAPSSKSTSGGTAALGCLVEDYFPEPVTVSWNSGAL<br>TSGVHTFPAVLQSSGLYSLSSVVTVPSCSLGTQTYICNVNHKPSNTKVDEKVEPKSCDKTHTCPPCPAPELRRGPKVFLFPPKPKDTLMI<br>SRTPEVTCVVVDVSHEDPEVKFNWYVDGVEVHNAKTKPREEQYASTYRVVSVLTVLHQDWLNGKEYKCKVSNKALPAPIEKTISKAK<br>GQPREPQVCTLPPSREEMTKNQVSLSCAVKGFYPSDIAVEWESNGQPENNYKTTPPVLDSDGSFFLVSKLTVDKSRWQEGNVFSCS<br>VMHEALHNHYTQKSLSLSP |
| 75 | DIVMTQSPLSLPVTPGEPASISCRSSQPLVHSNRNTYLHWYQQKPGQAPRLLIYKVSNRFSGVPDRFSGSGSGTDFTLKISRVEAEDV<br>GVYYCGQGTQVPYTFGQGTKLEIKSSASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCGGGGSGGGGSQVQLVESGGGLVQPGRSLRLSCAASGFTFSNAWMH<br>WVRQAPGKGLEWVAQIKDKGNAYAAYYAPSVKGRFTISRDDSKNSIYLQMNSLKTEDTAVYYCRYVHYASASTLLPAFGVDAWGQG<br>TTVTVSSASTKGPSVFPLAPSSKSTSGGTAALGCLVEDYFPEPVTVSWNSGALTSGVHTFPAVLQSSGLYSLSSVVTVPSCSLGTQTYICN<br>VNHKPSNTKVDEKVEPKSCDKTHTCPPCPAPELRRGPKVFLFPPKPKDTLMISRTPEVTCVVVDVSHEDPEVKFNWYVDGVEVHNA<br>KTKPREEQYASTYRVVSVLTVLHQDWLNGKEYKCKVSNKALPAPIEKTISKAKGQPREPQVYTLPPCREEMTKNQVSLWCLVKGFYPS<br>DIAVEWESNGQPENNYKTTPPVLDSDGSFFLYSKLTVDKSRWQEGNVFSCSVMHEALHNHYTQKSLSLSP |
| 76 | QVQLVESGGGLVQPGRSLRLSCAASGFTFSNAWMHWVRQAPGKGLEWVAQIKDKGNAYAAYYAPSVKGRFTISRDDSKNSIYLQM<br>NSLKTEDTAVYYCRYVHYASASTLLPAFGVDAWGQGTTVTVSSASTKGPSVFPLAPSSKSTSGGTAALGCLVEDYFPEPVTVSWNSGA<br>LTSGVHTFPAVLQSSGLYSLSSVVTVPSCSLGTQTYICNVNHKPSNTKVDEKVEPKSCDKTHTCPPCPAPELRRGPKVFLFPPKPKDTLM<br>ISRTPEVTCVVVDVSHEDPEVKFNWYVDGVEVHNAKTKPREEQYASTYRVVSVLTVLHQDWLNGKEYKCKVSNKALPAPIEKTISKA<br>KGQPREPQVCTLPPSREEMTKNQVSLSCAVKGFYPSDIAVEWESNGQPENNYKTTPPVLDSDGSFFLVSKLTVDKSRWQEGNVFSCS<br>VMHEALHNHYTQKSLSLSP |
| 77 | DIVMTQSPLSLPVTPGEPASISCQASQELVHMNRNTYLHWYQQKPGQAPRLLIYKVSNRFPGVPDRFSGSGSGTDFTLKISRVEAED<br>VGVYYCAQGTSVPFTFGQGTKLEIKRTVAAPSVFIFPPSDRKLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| 78 | DIVMTQSPLSLPVTPGEPASISCRSSQPLVHSNRNTYLHWYQQKPGQAPRLLIYKVSNRFSGVPDRFSGSGSGTDFTLKISRVEAEDV<br>GVYYCGQGTQVPYTFGQGTKLEIKSSASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCGGGGSGGGGSQVQLVESGGGLVQPGRSLRLSCAASGFKFSNTWFHW<br>VRQAPGKGLEWVAQIKDYYNDYAAYYAPSVKGRFTISRDDSKNSIYLQMNSLKTEDTAVYYCHYVHYASASTLLPAEGVDAWGQGTT<br>VTVSSASTKGPSVFPLAPSSKSTSGGTAALGCLVEDYFPEPVTVSWNSGALTSGVHTFPAVLQSSGLYSLSSVVTVPSCSLGTQTYICNV<br>NHKPSNTKVDEKVEPKSCDKTHTCPPCPAPELRRGPKVFLFPPKPKDTLMISRTPEVTCVVVDVSHEDPEVKFNWYVDGVEVHNAK<br>TKPREEQYASTYRVVSVLTVLHQDWLNGKEYKCKVSNKALPAPIEKTISKAKGQPREPQVYTLPPCREEMTKNQVSLWCLVKGFYPSD<br>IAVEWESNGQPENNYKTTPPVLDSDGSFFLYSKLTVDKSRWQEGNVFSCSVMHEALHNHYTQKSLSLSP |
| 79 | QVQLVESGGGLVQPGRSLRLSCAASGFKFSNTWFHWVRQAPGKGLEWVAQIKDYYNDYAAYYAPSVKGRFTISRDDSKNSIYLQMN<br>SLKTEDTAVYYCHYVHYASASTLLPAEGVDAWGQGTTVTVSSASTKGPSVFPLAPSSKSTSGGTAALGCLVEDYFPEPVTVSWNSGAL<br>TSGVHTFPAVLQSSGLYSLSSVVTVPSCSLGTQTYICNVNHKPSNTKVDEKVEPKSCDKTHTCPPCPAPELRRGPKVFLFPPKPKDTLMI<br>SRTPEVTCVVVDVSHEDPEVKFNWYVDGVEVHNAKTKPREEQYASTYRVVSVLTVLHQDWLNGKEYKCKVSNKALPAPIEKTISKAK<br>GQPREPQVCTLPPSREEMTKNQVSLSCAVKGFYPSDIAVEWESNGQPENNYKTTPPVLDSDGSFFLVSKLTVDKSRWQEGNVFSCS<br>VMHEALHNHYTQKSLSLSP |
| 80 | DIVMTQSPLSLPVTPGEPASISCRSSQPLVHSNRNTYLHWYQQKPGQAPRLLIYKVSNRFSGVPDRFSGSGSGTDFTLKISRVEAEDV<br>GVYYCGQGTQVPYTFGQGTKLEIKSSASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCGGGGSGGGGSQVQLVESGGGLVQPGRSLRLSCAASGFKFSNVWFHW<br>VRQAPGKGLEWVAQIKDYYNAYAAYYAPSVKGRFTISRDDSKNSIYLQMNSLKTEDTAVYYCHYVHYASASTLLPAEGVDAWGQGTT<br>VTVSSASTKGPSVFPLAPSSKSTSGGTAALGCLVEDYFPEPVTVSWNSGALTSGVHTFPAVLQSSGLYSLSSVVTVPSCSLGTQTYICNV<br>NHKPSNTKVDEKVEPKSCDKTHTCPPCPAPELRGGPKVFLFPPKPKDTLMISRTPEVTCVVVDVSHEDPEVKFNWYVDGVEVHNAK<br>TKPREEQYASTYRVVSVLTVLHQDWLNGKEYKCKVSNKALPAPIEKTISKAKGQPREPQVYTLPPCREEMTKNQVSLWCLVKGFYPSD<br>IAVEWESNGQPENNYKTTPPVLDSDGSFFLYSKLTVDKSRWQEGNVFSCSVMHEALHNHYTQKSLSLSP |
| 81 | QVQLVESGGGLVQPGRSLRLSCAASGFKFSNVWFHWVRQAPGKGLEWVAQIKDYYNAYAAYYAPSVKGRFTISRDDSKNSIYLQMN<br>SLKTEDTAVYYCHYVHYASASTLLPAEGVDAWGQGTTVTVSSASTKGPSVFPLAPSSKSTSGGTAALGCLVEDYFPEPVTVSWNSGAL<br>TSGVHTFPAVLQSSGLYSLSSVVTVPSCSLGTQTYICNVNHKPSNTKVDEKVEPKSCDKTHTCPPCPAPELRGGPKVFLFPPKPKDTLMI<br>SRTPEVTCVVVDVSHEDPEVKFNWYVDGVEVHNAKTKPREEQYASTYRVVSVLTVLHQDWLNGKEYKCKVSNKALPAPIEKTISKAK<br>GQPREPQVCTLPPSREEMTKNQVSLSCAVKGFYPSDIAVEWESNGQPENNYKTTPPVLDSDGSFFLVSKLTVDKSRWQEGNVFSCS<br>VMHEALHNHYTQKSLSLSP |
| 82 | DIVMTQSPLSLPVTPGEPASISCQPSQEVVHMNRNTYLHWYQQKPGQAPRLLIYKVSNRFPGVPDRFSGSGSGTDFTLKISRVEAED<br>VGVYYCAQGTSHPFTFGQGTKLEIKRTVAAPSVFIFPPSDRKLKSGTASVVCLLNNFYPREAKVQWKVDNALQSGNSQESVTEQDSK<br>DSTYSLSSTLTLSKADYEKHKVYACEVTHQGLSSPVTKSFNRGEC |

TABLE 2.3-continued

| SEQ list | Amino Acid Sequence |
|---|---|
| 83 | EPKSSDKTHTCPPCPAPELRGGPKVFLFPPKPKDTLMISRTPEVTCVVVDVSHEDPEVKFNWYVDGVEVHNAKTKPREEQYASTYRV VSVLTVLHQDWLNGKEYKCKVSNKALPAPIEKTISKAKGQPREPQVCTLPPSREEMTKNQVSLSCAVKGFYPSDIAVEWESNGQPEN NYKTTPPVLDSDGSFFLVSKLTVDKSRWQEGNVFSCSVMHEALHNHYTQKSLSLSP |
| 84 | DIVMTQSPLSLPVTPGEPASISCRSSQPLVHSNRNTYLHWYQQKPGQAPRLLIYKVSNRFSGVPDRFSGSGSGTDFTLKISRVEAEDV GVYYCGQGTQVPYTFGQGTKLEIKSSASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSCGGGGSGGGGSQVQLVESGGGLVQPGRSLRLSCAASGFKFSNVWFHW VRQAPGKGLEWVAQIKDYYNAYAAYYAPSVKGRFTISRDDSKNSIYLQMNSLKTEDTAVYYCHYVHYASASTLLPAEGVDAWGQGTT VTVSSASTKGPSVFPLAPSSKSTSGGTAALGCLVEDYFPEPVTVSWNSGALTSGVHTFPAVLQSSGLYSLSSVVTVPSSSLGTQTYICNV NHKPSNTKVDEKVEPKSCDKTHTCPPCPAPELRGGPKVFLFPPKPKDTLMISRTPEVTCVVVDVSHEDPEVKFNWYVDGVEVHNAK TKPREEQYASTYRVVSVLTVLHQDWLNGKEYKCKVSNKALPAPIEKTISKAKGQPREPQVYTLPPCREEMTKNQVSLWCLVKGFYPSD IAVEWESNGQPENNYKTTPPVLDSDGSFFLYSKLTVDKSRWQEGNVFSCSVMHEALHNHYTQKSLSLSP |

3.2. Comparison of 1+2 Trivalent Format Versus 1+2 Trivalent (Line) Format in GPC3 Negative Cell Line To evaluate potential toxicity as observed by 1+2 trivalent GPC3-Dual/Dual, CHO cell line overexpressing CD137 was co-cultured with purified activated T cells E:T 5 for 48h using lactate dehydrogenase (LDH) assay (Promega) according to manufacturer's instructions. T cells were purified from PBMCs using EasySep Human T cell isolation kit (STEMCELL Technologies) and cultured in anti-CD3/CD28 Dynabeads (Thermo Fisher Scientific) for 7 days supplemented with 50U/mL of recombinant human IL-2 (STEMCELL technologies).

As shown in FIG. 3.2, 1+2 trivalent GPC3-Dual/Dual format shows strong cell lysis in a dose-dependent manner even in the absence of GPC3 expression. Stronger killing is also observed for Ctrl-Dual/Dual molecule. More importantly, 1+2 trivalent antibodies (line) with 191C-191C crosslinking showed reduced lysis of CHO cells expressing CD137. In particular. GPC3-Dual/Dual (line) did not show significant lysis (from 12% to 16%) when antibody concentration is increased from 5 nM to 20 nM. However. GPC3-Dual/Dual (1+2) increased from 33% to 51% when antibody concentration is increased from 5 nM to 20 nM. This data suggest that introduction of crosslinking to trivalent molecules could reduce trans-binding between immune cells and thus, reduce unintended tumor antigen independent toxicity.

3.3. Measurement of In Vitro Efficacy and Cytokine Release Using Linc Trivalent Format on GPC3 Positive Cancer Cells We next investigated in vitro TDCC activity using xCELLigence described in Example 1.1 comparing various 1+2 trivalent line-Ig formats (FIG. 2.1*b*) where we co-cultured NCI-H446 cells with PBMCs at ET ratio 0.5. FIG. 3.3 showed that GPC3-Dual/Dual (line). GPC3-Dual/CD137 (line) and GPC3-CD3/CD3 (line) showed stronger TDCC activity than conventional GPC3/Dual (1+1) at 1, 3 and 10 nM. Of note. GPC3/Dual (1+1) showed weaker TDCC activity than GPC3/CD3 epsilon (1+1) in NCI-H446 cell line unlike in SK-pca60 cell line that has a much higher GPC3 expression (FIG. 2.3*a*) This shows that target antigen expression could provide the limitation for CD137 clustering required for agonistic activity. Stronger TDCC activity by line-Ig variants suggest that receptor clustering on effector cells may increase potency of cytotoxicity.

Interestingly, GPC3-CD137/Dual showed much weaker TDCC activity than GPC3-Dual/CD137 and GPC3/Dual (1+1) (FIG. 2.1*d*). This suggest that distance between tumor and effector cells proved to be critical since GPC3/Dual (2Fab) shows stronger TDCC than GPC3/Dual (1+1) (FIG. 2.3*b*. 3.3). In addition, steric hindrance or reduced accessibility as a result of crosslinking between CD3 binding Fab and Dual-Fab may also contribute the weaker TDCC of GPC3-CD3/Dual (line) variant. As such, distance and accessibility towards CD3 binding on T cells may be critical for formation of cytolytic immune synapse for potency.

The antibodies were also evaluated for cytokine release. Total cytokine release was evaluated using cytometric bead array (CBA) Human Th1/T2 Cytokine kit II (BD Biosciences #551809). IL-2, IL-6, IFN gamma and TNF alpha were evaluated. As shown in FIG. 3.4, incubation with GPC3/Dual of NCI-H446 and PBMCs co-cultured at E:T 1 shows weak IL-2, IFN gamma and TNF alpha cytokine production when we analysed the supernatant from cell culture at 40h. Correlating to FIG. 3.3, cytokine release of GPC3/Dual (1+1) was not higher than GPC3/CD3 epsilon (1+1) suggesting that 1+1 conventional IgG format may not be sufficient to improve potency in tumor cell line when GPC3 tumor antigen expression is low.

GPC3-Dual/Dual, GPC3-Dual/CD137 showed the strongest IL-2. IFN gamma and TNF alpha production. For instance, IL-2 and IFN gamma production was at least 10 fold greater than that of GPC3/Dual, while TNF alpha production was at least 3 fold more than GPC3/Dual antibody. Of note. GPC3-Dual/Dual showed stronger cytokine production than GPC3-CD3/CD3 even though TDCC activity of both antibodies were similarly strong in FIG. 3.3, suggesting that the functional CD137 engagement is responsible for increase in cytokine release observed. Similarly, GPC3/Dual (2Fab) shows slightly weaker IL-2 and IFN gamma cytokine release than GPC3-Dual/CD137, especially at 2.5 nM antibody concentration. This may suggest that bivalent CD137 engagement could contribute to increase IL-2 and IFN gamma production. In addition, correlating to TDCC activity, GPC3-CD137/Dual showed the weakest cytokine release. Altogether, GPC3-Dual/Dual (line), GPC3-Dual/CD137 (line) antibodies showed the most desirable profile of significant improvement in TDCC activity compared to GPC3/Dual (1+1) in tumor cell line with low GPC3 tumor target expression (correlated with increased IL-2 and IFN gamma and TNF alpha), providing a strong rationale to further evaluate and develop these antibody formats for clinical use.

[Reference Example 1] Obtainment of Fab Domain Binding to CD3 Epsilon and Human CD137 from Dual Fab Phage Display Library 1.1. Construction of Heavy Chain Phage Display Library with GLS3000 Light Chain The antibody library fragments synthesized in Reference Example 12 was used to construct the dual Fab library for phage display. The dual library was prepared as a library in which H chains are diversified as shown in Reference Example 12 while L chains are fixed to the original sequence GLS3000 (SEQ ID NO: 85). The H chain library sequences derived from CE115HA000 by adding the V11L/L781 mutation to FR (framework) and further diversifying CDRs as shown in Table 27 (in Reference Example 12) were entrusted to the DNA synthesizing company DNA2.0, Inc, to obtain antibody library fragments (DNA fragments). The obtained antibody library fragments were inserted to phagemids for phage display amplified by PCR. GLS3000 was selected as L chains. The constructed phagemids for phage display were transferred to *E. coli* by electroporation to prepare *E. coli* harboring the antibody library fragments. Phage library displaying Fab domain were produced from the *E. coli* harboring the constructed phagemids by infection of helper phage M13KO7TC/FkpA which code FkpA chaperone gene and then incubate in the presence of 0.002% arabinose at 25 degrees Celsius (this phage library named as DA library) or 0.02% arabinose at 20 degrees Celsius (this phage library named as DX library) for overnight. M13KO7TC is a helper phage which has an insert of the trypsin cleavage sequence between the N2 domain and the CT domain of the pIII protein on the helper phage (see National Publication of International Patent Application No. 2002-514413). Introduction of insert gene into M13KO7TC gene have been already disclosed elsewhere (see National Publication of International Patent Application No. WO2015046554).

1.2. Obtainment of Fab Domain Binding to CD3 Epsilon and Human CD137 with Double Round Selection Fab domains binding to CD3 epsilon and human CD137 were identified from the dual Fab library constructed in Reference Example 1.1. Biotin-labeled CD3 epsilon peptide antigen (amino acid sequence: SEQ ID NO: 86). CD3 epsilon peptide antigen biotin-labeled through disulfide-bond linker (FIG. 4, called C3NP1-27; amino acid sequence: SEQ ID NO: 194, synthesized by Genscript), biotin-labeled human CD137 fused to human IgG1 Fc fragment (named as human CD137-Fc) and SS-biotinylated human CD137 fused to human IgG1 Fc fragment (named as ss-human CD137-Fc) was used as an antigen, ss-human CD137-Fc was prepared by using EZ-Link Sulfo-NHS—SS-Biotinylation Kit (PIERCE, Cat. No. 21445) to human CD137 fused to human IgG1 Fc fragment. Biotinylation was conducted in accordance with the instruction manual. Phages were produced from the *E. coli* harboring the constructed phagemids for phage display. 2.5 M NaCl/10% PEG was added to the culture solution of the *E. coli* that had produced phages, and a pool of the phages thus precipitated was diluted with TBS to obtain a phage library solution. Next. BSA (final concentration: 4%) was added to the phage library solution. The panning method was performed with reference to a general panning method using antigens immobilized on magnetic beads (J. Immunol. Methods. (2008) 332 (1-2), 2-9: J. Immunol Methods. (2001) 247 (1-2), 191-203; Biotechnol. Prog. (2002) 18 (2) 212-20; and Mol. Cell Proteomics (2003) 2 (2), 61-9). The magnetic beads used were NeutrAvidin coated beads (Sera-Mag SpeedBeads NeutrAvidin-coated) or Streptavidin coated beads (Dynabeads M-280 Streptavidin). To eliminate antibodies displaying phage which bind to magnetic beads itself or human IgG1 Fc region, subtraction for magnetic beads and biotin labeled human Fc was conducted.

Specifically, Phage solution was mixed with 250 pmol of human CD137-Fc and 4 nmol of free human IgG1 Fc domain and incubated at room temperature for 60 minutes. Magnetic beads was blocked by 2% skim-milk/TBS with free Streptavidin (Roche) at room temperature for 60 minutes or more and washed three times with TBS, and then mixed with incubated phage solution. After incubation at room temperature for 15 minutes, the beads were washed three-times with TBST (TBS containing 0.1% Tween 20; TBS was available from Takara Bio Inc.) and then further washed twice with 1 mL of TBS. 5 micro L of 100 mg/mL Trypsin and 495 micro L of TBS were added and incubated at room temperature for 15 minutes, immediately after which the beads were separated using a magnetic stand to recover phage solution. The *E. coli* strain was infected by the phages through the gentle spinner culture of the strain at 37 degrees C. for 1 hour. The infected *E. coli* was inoculated to a plate of 225 mm×225 mm. Next, phages were recovered from the culture solution of the inoculated *E. coli* to prepare a phage library solution.

In this panning round 1 procedure antibody displaying phages which bind to human CD137 was concentrated. In the 2nd round of panning, 250 pmol of ss-human CD137-Fc was used as biotin-labeled antigen and wash was conducted three-times with TBST and then two-times with TBS. Elution was conducted with 25 mM DTT at room temperature for 15 minutes and then digested by Trypsin.

In the $3^{rd}$ round and $6^{th}$ round of panning, 62.5 pmol of C3NP1-27 was used as biotin-labeled antigen and wash was conducted three-times with TBST and then two-times with TBS. Elution was conducted with 25 mM DTT at room temperature for 15 minutes and then digested by Trypsin.

In the $4^{th}$, $5^{th}$ and $7^{th}$ round of panning, 62.5 pmol of ss-human CD137-Fc was used as biotin-labeled antigen and wash was conducted three-times with TBST and then two-times with TBS. Elution was conducted with 25 mM DTT at room temperature for 15 minutes and then digested by Trypsin.

1.3. Binding of Fab Domain Displayed by Phage to CD3 Epsilon or Human CD137

A phage-containing culture supernatant was recovered according to a general method (Methods Mol. Biol. (2002) 178, 133-145) from each 96 single colony of the *E. coli* obtained by the method described above. The phage-containing culture supernatant was subjected to ELISA by the following procedures: Streptavidin-coated Microplate (384well, greiner. Cat #781990) was coated overnight at 4 degrees C., or at room temperature for 1 hour with 10 micro L of TBS containing the biotin-labeled antigen (biotin-labeled CD3 epsilon peptide or biotin-labeled human CD137-Fc). Each well of the plate was washed with TBST to remove unbound antigens. Then, the well was blocked with 80 micro L of TBS/2% skim milk for 1 hour or longer. After removal of TBS/2% skim milk, the prepared culture supernatant was added to each well, and the plate was left standing at room temperature for 1 hour so that the phage-displayed antibody bound to the antigen contained in each well. Each well was washed with TBST, and HRP/Anti M13 (GE Healthcare 27-9421-01) were then added to each well. The plate was incubated for 1 hour. After washing with TBST, TMB single solution (ZYMED Laboratories. Inc.) was added to the well. The chromogenic reaction of the solution in each well was terminated by the addition of sulfuric acid. Then, the developed color was assayed on the basis of absorbance at 450 nm. The results are shown in FIG. 5.

As shown in FIG. 5, all clones showed binding to human CD3 epsilon but did not show binding to human CD137 even though panning procedure to human CD137 was conducted S-times. It might depend on the less sensitivity of this phage ELISA analysis with Streptavidin-coated Microplate so phage ELISA with Streptavidin coated beads was also conducted.

1.4. Binding of Fab Domain Displayed by Phage to Human CD137 (Phage Beads ELISA)

First, Streptavidin-coated magnetic beads MyOne-T1 beads was washed three-times with blocking buffer including 0.5× block Ace, 0.02% Tween and 0.05% ProClin 300 and then blocked with this blocking buffer at room temperature for 60 minutes or more. After washing once with TBST, 0.625 pmol of ss-human CD137-Fc was added to magnetic beads and incubated at room temperature for 10 minutes or more and then magnetic beads were applied to each well of 96well plate (Corning, 3792 black round bottom PS plate). 12.5 micro L each of the Fab displaying phage solution with 12.5 micro L of TBS was added to the wells, and the plate was allowed to stand at room temperature for 30 minutes to allow each Fab to bind to biotin-labeled antigen in each well. After that each well was washed with TBST. Anti-M13 (p8) Fab-HRP diluted with blocking buffer including 0.5× block Ace, 0.02% Tween and 0.05% ProClin 300 was added to each well. The plate was incubated for 10 minutes. After washing 3-times with TBST, LumiPhos-HRP (Lumigen) was added to each well. 2 minutes later the fluorescence of each well was detected. The measurement results are shown in FIG. 6.

Some clones showed obvious binding to human CD137. This result showed that some Fab domains which bind to both human CD3 epsilon and CD137 were also obtained from this designed library with phage display panning strategy. Nonetheless the binding to human CD137 was still weak compared to CD3 epsilon peptide. The VH fragment of each human CD137 binding clones were amplified by PCR using primers specifically binding to the phagemid vector (SEQ ID NOs: 196 and 197) and the DNA sequences were analyzed. The result showed all binding clones have same VH sequence, it meant only one Fab clone showed binding to both human CD137 and CD3 epsilon. To improve this, double round selection was also applied to phage display strategy in next experiment.

[Reference Example 2] Obtainment of Fab Domain Binding to CD3 Epsilon and Human CD137 from Dual Fab Phage Display Library with Double Round Selection Method 2.1. Construction of Heavy chain phage display library with GLS3000 Light chain Phage library displaying Fab domain were produced from the *E. coli* harboring the constructed phagemids by infection of helper phage M13KO7TC/FkpA which code FkpA chaperone (SEQ ID NO: 91) and then incubate in the presence of 0.002% arabinose at 25 degrees Celsius (this phage library named as DA library) or 0.02% arabinose at 20 degrees Celsius (this phage library named as DX library) for overnight. M13KO7TC is a helper phage which has an insert of the trypsin cleavage sequence between the N2 domain and the CT domain of the pIII protein on the helper phage (see Japanese Patent Application Kohyo Publication No. 2002-514413). Introduction of insert gene into M13KO7TC gene have been already disclosed elsewhere (see WO2015/046554).

2.2. Obtainment of Fab Domain Binding to CD3 Epsilon and Human CD137 with Double Round Selection Fab domains binding to CD3 epsilon and human CD137 were identified from the dual Fab library constructed in Reference Example 2.1. Biotin-labeled CD3 epsilon peptide antigen (amino acid sequence: SEQ ID NO: 86). CD3 epsilon peptide antigen biotin-labeled through disulfide-bond linker (C3NP1-27: SEQ ID NO: 194) and biotin-labeled human CD137 fused to human IgG1 Fe fragment (named as human CD137-Fc) was used as an antigen.

To produce much more Fab domain binding to human CD137 and CD3 epsilon, double round selection was also applied for phage display panning at panning round2 and subsequent round.

Phages were produced from the *E. coli* harboring the constructed phagemids for phage display. 2.5 M NaCl/10% PEG was added to the culture solution of the *E. coli* that had produced phages, and a pool of the phages thus precipitated was diluted with TBS to obtain a phage library solution. Next, BSA (final concentration: 4%) was added to the phage library solution. The panning method was performed with reference to a general panning method using antigens immobilized on magnetic beads (J. Immunol. Methods. (2008) 332 (1-2), 2-9; J. Immunol. Methods. (2001) 247 (1-2), 191-203; Biotechnol. Prog. (2002) 18 (2) 212-20; and Mol. Cell Proteomics (2003) 2 (2), 61-9). The magnetic beads used were NeutrAvidin coated beads (Sera-Mag SpeedBeads NeutrAvidin-coated) or Streptavidin coated beads (Dynabeads M-280 Streptavidin). To eliminate antibodies displaying phage which bind to magnetic beads itself or human IgG1 Fc region, subtraction for magnetic beads and biotin labeled human Fc was conducted.

Specifically, at panning round1, magnetic beads was blocked by 2% skim-milk/TBS at room temperature for 60 minutes or more and washed three times with TBS. Phage solution of DA library or DX library were added to blocked magnetic beads and incubated at room temperature for 60 minutes or more, then supernatant was recovered 500 pmol of biotin labeled human IgG1 Fc was added to new magnetic beads and incubated at room temperature for 15 minutes and then add 2% skim-milk/TBS. After blocking at room temperature for 60 minutes or more, magnetic beads was washed three times with TBS. Recovered phage solution were added to blocked magnetic beads and incubated at room temperature for 60 minutes or more, then supernatant was recovered. 500 pmol of the biotin-labeled CD137-Fc was added to new magnetic beads and incubated at room temperature for 15 minutes and then add 2% skim-milk/TBS. After blocking at room temperature for 60 minutes or more, magnetic beads was washed three times with TBS. Recovered phage solution were added to blocked magnetic beads and 8 nmol of free human IgG1

Fc domain was also added, and then incubated at room temperature for 60 minutes. The beads were washed twice with TBST (TBS containing 0.1% Tween 20; TBS was available from Takara Bio Inc) and then further washed once with 1 mL of TBS. After addition of 0.5 mL of 1 mg/mL trypsin, the beads were suspended at room temperature for 15 minutes, immediately after which the beads were separated using a magnetic stand to recover a phage solution. The recovered phage solution was added to an *E. coli* strain ER2738 in a logarithmic growth phase (OD600: 0.4-0.5) The *E. coli* strain was infected by the phages through the gentle spinner culture of the strain at 37 degrees C. for 1 hour. The infected *E. coli* was inoculated to a plate of 225 mm×225 mm. Next, phages were recovered from the culture solution of the inoculated *E. coli* to prepare a phage library solution.

In this panning round 1 procedure antibody displaying phages which bind to human CD137 was concentrated so from next round of panning procedure double round selection was conducted to recover antibody displaying phages which bind to both CD3 epsilon and human CD137.

Specifically, at panning round2, magnetic beads was blocked by 2% skim-milk/TBS at room temperature for 60 minutes or more and washed three times with TBS. Phage solution were added to blocked magnetic beads and incubated at room temperature for 60 minutes or more, then supernatant was recovered. 500 pmol of biotin labeled human IgG1 Fc was added to new magnetic beads and incubated at room temperature for 15 minutes and then add 2% skim-milk/TBS. After blocking at room temperature for 60 minutes or more, magnetic beads was washed three times with TBS. Recovered phage solution were added to blocked magnetic beads and incubated at room temperature for 60 minutes or more, then supernatant was recovered. 500 pmol of the biotin-labeled CD137-Fc was added to new magnetic beads and incubated at room temperature for 15 minutes and then add 2% skim-milk/TBS.

After blocking at room temperature for 60 minutes or more, magnetic beads was washed three times with TBS. Recovered phage solution were added to blocked magnetic beads and then incubated at room temperature for 60 minutes. The beads were washed three times with TBST (TBS containing 0.1% Tween 20; TBS was available from Takara Bio Inc.) and then further washed twice with 1 mL of TBS. FabRICATOR (IdeS, protease for hinge region of IgG, GENOVIS) (named as IdeS elution campaign) was used to recover antibody displaying phages. In that procedure, 10 units/micro L Fabricator 20 micro L with 80 micro L TBS buffer was added and beads were suspended at 37 degrees Celsius for 30 minutes, immediately after which the beads were separated using a magnetic stand to recover phage solution.

In this Is cycle of panning procedure antibody displaying phages which bind to human CD137 was concentrated so then move on to 2$^{nd}$ cycle panning procedure to recover antibody displaying phages which also bind to CD3 epsilon before phage infection and amplification. 500 pmol of the biotin-labeled CD3 epsilon was added to new magnetic beads and incubated at room temperature for 15 minutes and then add 2% skim-milk/TBS. After blocking at room temperature for 60 minutes or more, magnetic beads was washed three times with TBS. Recovered phage solution, 50 micro L of TBS and 250 micro L of 8% BSA blocking buffer were added to blocked magnetic beads and then incubated at 37 degrees Celsius for 30 minutes, at room temperature for 60 minutes, 4 degrees Celsius for overnight and then at room temperature for 60 minutes to transfer antibody displaying phage from human CD137 to CD3 epsilon.

The beads were washed three times with TBST (TBS containing 0.1% Tween 20; TBS was available from Takara Bio Inc.) and then further washed twice with 1 mL of TBS. The beads supplemented with 0.5 mL of 1 mg/mL trypsin were suspended at room temperature for 15 minutes, immediately after which the beads were separated using a magnetic stand to recover a phage solution. The phages recovered from the trypsin-treated phage solution were added to an *E. coli* strain ER2738 in a logarithmic growth phase (OD600: 0.4-0.7). The *E. coli* strain was infected by the phages through the gentle spinner culture of the strain at 37 degrees C., for 1 hour. The infected *E. coli* was inoculated to a plate of 225 mm×225 mm. Next, phages were recovered from the culture solution of the inoculated *E. coli* to recover a phage library solution.

In the third and fourth round of panning, wash number increased to fifth with TBST and then twice with TBS. In 200 cycle of double round selection, C3NP J-27 antigen was used instead of biotin labeled CD3 epsilon peptide antigen, and elution was conducted by DTT solution to cleave the disulfide bond between CD3 epsilon peptide and biotin. Precisely, after washing with TBS twice, 500 micro L of 25 mM DTT solution was added and beads were suspended at room temperature for 15 minutes, immediately after which the beads were separated using a magnetic stand to recover phage solution. 0.5 mL of 1 mg/mL trypsin were added to recovered phage solution and incubated at room temperature for 15 minutes

2.3. Binding of IgG Having Obtained Fab Domain to Human CD137 and Cynomolgus Monkey CD137

96 clones were picked from each panning output pools of DA and DX library at round3 and round4 and their VH gene sequence were analyzed. Twenty-nine VH sequence was obtained so all of them were converted into IgG format. The VH fragments of each clones were amplified by PCR using primers specifically binding to the phagemid vector (SEQ ID NOs: 196 and 197). The amplified VH fragment was integrated into an animal expression plasmid which have already had human IgG1 CH1-Fc region. The prepared plasmids were used for expression in animal cells by the method of Reference Example 9. GLS3000 was used as Light chain and its expression plasmid was prepared as shown in Reference Example 12.2).

The prepared antibodies were subjected to ELISA to evaluate their binding capacity to human CD137 (SEQ ID NO: 195) and cynomolgus monkey (called as cyno) CD137 (SEQ ID NO: 92). FIG. 7 shows the amino acids sequence difference between human and cynomolgus monkey CD137. There are 8 different residues among them.

First, 20 micro g of Streptavidin-coated magnetic beads MyOne-T1 beads was washed three-times with blocking buffer including 0.5× block Ace, 0.02% Tween and 0.05% ProClin 300 and then blocked with this blocking buffer at room temperature for 60 minutes or more. After washing once with TBST, magnetic beads were applied to each well of white round bottom PS plate (Corning, 3605) and 0.625 pmol of biotin labeled human CD137-Fc, biotin labeled cyno CD137-Fc or biotin labeled human Fc was added to magnetic beads and incubated at room temperature for 15 minutes or more. After washing once with TBST, 25 micro L each of the 50 ng/micro L purified IgG was added to the wells, and the plate was allowed to stand at room temperature for one hour to allow each IgG to bind to biotin-labeled antigen in each well.

After that each well was washed with TBST. Goat anti-human kappa Light chain alkaline phosphatase conjugate (BETHYL, A80-115AP) diluted with TBS was added to each well. The plate was incubated for one hour. After washing with TBST, each sample were transferred to 96well plate (Corning, 3792 black round bottom PS plate) and APS-5 (Lumigen) was added to each well. 2 minutes later the fluorescence of each well was detected. The measurement results are shown in Table 3 and FIG. 8. Among them, clones DXDU01_3 #094, DXDU01_3 #072. DADU01_3 #018, DADU01_3 #002, DXDU01_3 #019 and DXDU01_3 #051 showed binding to both human and cyno CD137. On the other hand, DADU01_3 #001, which showed strongest binding to human CD137, did not show binding to cyno CD137.

[Table 3]

TABLE 3

| | RLU | | | S/N ratio | | |
|---|---|---|---|---|---|---|
| | Fc | human CD137-Fc | cyno CD137-Fc | human CD137-Fc/Fc | cyno CD137-Fc/Fc | SEQ ID NO |
| DADU01_3#031 | 2122 | 1633 | 1783 | 0.7696 | 0.8402 | |
| DXDU01_3#053 | 1935 | 1469 | 1555 | 0.7592 | 0.8036 | |
| DADU01_3#006 | 3202 | 1842 | 1886 | 0.5753 | 0.5890 | |
| DXDU01_3#035 | 2005 | 1424 | 1484 | 0.7102 | 0.7401 | |
| DXDU01_3#064 | 1826 | 1369 | 2150 | 0.7497 | 1.1774 | |
| DADU01_3#036 | 1960 | 1491 | 2173 | 0.7607 | 1.1087 | |
| DXDU01_3#043 | 2311 | 1533 | 1919 | 0.6633 | 0.8304 | |
| DXDU01_3#094 | 2367 | 24241 | 19145 | 10.2412 | 8.0883 | 97 |
| DADU01_3#003 | 2349 | 1596 | 1658 | 0.6794 | 0.7058 | |
| DADU01_3#051 | 2276 | 1595 | 1534 | 0.7008 | 0.6740 | |
| DADU01_4#089 | 3578 | 1970 | 1894 | 0.5506 | 0.5293 | |
| DADU01_3#013 | 2770 | 1707 | 1710 | 0.6162 | 0.6173 | |
| DXDU01_3#049 | 2586 | 1559 | 1578 | 0.6029 | 0.6102 | |
| DXDU01_3#072 | 2148 | 14137 | 3348 | 6.5815 | 1.5587 | 98 |
| DADU01_3#042 | 2570 | 1779 | 1600 | 0.6922 | 0.6226 | |
| DADU01_3#020 | 1970 | 1640 | 1641 | 0.8325 | 0.8330 | |
| DADU01_3#050 | 2246 | 1785 | 1689 | 0.7947 | 0.7520 | |
| DADU01_3#018 | 1899 | 32770 | 6205 | 17.2565 | 3.2675 | 99 |
| DADU01_3#002 | 1924 | 39141 | 10775 | 20.3436 | 5.6003 | 100 |
| DADU01_3#058 | 1931 | 1461 | 1363 | 0.7566 | 0.7059 | |
| DADU01_3#078 | 1689 | 1374 | 1326 | 0.8135 | 0.7851 | |
| DADU01_3#044 | 1992 | 1647 | 1606 | 0.8268 | 0.8062 | |
| DXDU01_3#019 | 3264 | 77805 | 5093 | 23.8373 | 1.5604 | 101 |
| DADU01_3#001 | 1760 | 95262 | 1209 | 54.1261 | 0.6869 | 102 |
| DADU01_3#071 | 3389 | 1927 | 1860 | 0.5686 | 0.5488 | |
| DADU01_3#024 | 3131 | 1783 | 1763 | 0.5695 | 0.5631 | |
| DXDU01_3#051 | 2914 | 38065 | 10870 | 13.0628 | 3.7303 | 103 |
| DADU01_3#004 | 3053 | 1918 | 1802 | 0.6282 | 0.5902 | |
| DADU01_3#045 | 1988 | 1662 | 1573 | 0.8360 | 0.7912 | |

2.4. Binding of IgG Having Obtained Fab Domain to Human CD3 Epsilon

Each antibodies were also subjected to ELISA to evaluate their binding capacity to CD3 epsilon.

First, a MyOne-T1 streptavidin beads were mixed with 0.625 pmol of biotin-labeled CD3 epsilon and incubated at room temperature for 10 minutes, then blocking buffer including 0.5× block Ace, 0.02% Tween and 0.05% ProClin 300/TBS was added to block the magnetic beads. Mixed solution was dispended to each well of 96well plate (Corning, 3792 black round bottom PS plate) and incubated at room temperature for 60) minutes or more. After that magnetic beads were washed by TBS once, 100 ng of purified IgG was added to the magnetic beads in each well, and the plate was allowed to stand at room temperature for one hour to allow each IgG to bind to biotin-labeled antigen in each well.

After that each well was washed with TBST, Goat anti-human kappa Light chain alkaline phosphatase conjugate (BETHYL, A80-115AP) diluted with TBS was added to each well. The plate was incubated for one hour. After washing with TBST, APS-5 (Lumigen) was added to each well. 2 minutes later the fluorescence of each well was detected. The measurement results are shown in Table 4 and FIG. 9. All clones showed obvious binding to CD3 epsilon peptide. These data proves the Fab domain which bind to both CD3 epsilon, human CD137 and cyno CD137 could be efficiently obtained by designed Dual Fab antibody phage display library with double round selection procedure with higher hit-rate than with conventional phage display panning procedure conducted in Reference Example 1.

[Table 4]

TABLE 4

| | RLU | | S/N ratio CD3 peptide/ |
|---|---|---|---|
| | Non coating | CD3 peptide | non coating |
| DADU01_3#031 | 1505 | 142935 | 70.13 |
| DXDU01_3#053 | 2082 | 148836 | 120.32 |
| DADU01_3#006 | 3843 | 127079 | 107.42 |
| DXDU01_3#035 | 3302 | 119726 | 103.03 |
| DXDU01_3#064 | 3901 | 171861 | 147.52 |
| DADU01_3#036 | 1562 | 159897 | 139.65 |
| DXDU01_3#043 | 1147 | 168793 | 143.65 |
| DXDU01_3#094 | 2473 | 164780 | 140.72 |
| DADU01_3#003 | 3104 | 151738 | 115.65 |
| DADU01_3#051 | 2489 | 135224 | 109.85 |
| DADU01_4#089 | 1366 | 150267 | 127.67 |
| DADU01_3#013 | 4688 | 136821 | 111.78 |
| DXDU01_3#049 | 3205 | 141259 | 114.94 |
| DXDU01_3#072 | 2168 | 176615 | 147.67 |
| DADU01_3#042 | 4271 | 135203 | 108.86 |
| DADU01_3#020 | 1454 | 197301 | 153.18 |
| DADU01_3#050 | 1564 | 166509 | 132.05 |
| DADU01_3#018 | 2293 | 181896 | 148.73 |
| DADU01_3#002 | 2954 | 173838 | 156.47 |
| DADU01_3#058 | 2618 | 136587 | 118.05 |
| DADU01_3#078 | 1754 | 146653 | 124.49 |
| DADU01_3#044 | 1091 | 196612 | 180.88 |
| DXDU01_3#019 | 1919 | 190761 | 161.12 |
| DADU01_3#001 | 1840 | 198383 | 146.41 |
| DADU01_3#071 | 4237 | 144562 | 109.60 |
| DADU01_3#024 | 3782 | 152018 | 129.38 |
| DXDU01_3#051 | 1904 | 169289 | 144.69 |
| DADU01_3#004 | 2310 | 166261 | 141.26 |
| DADU01_3#045 | 1730 | 154444 | 127.85 |

2.5. Evaluation of Binding of IgG Having Obtained Fab Domain to CD3 Epsilon and Human CD137 at Same Time Six antibodies (DXDU01_3 #094 (#094). DADU01_3 #018 (#018). DADU01_3 #002 (#002). DXDU01_3 #019 (#019) DXDU01_3 #051 (#051) and DADU01_3 #001 (#001 or dBBDu_126)) were selected to evaluate further. An anti-human CD137 antibody (SEQ ID NO: 93 for the Heavy chain and SEQ ID NO: 94 for the Light chain) described in WO2005/035584A1 (abbreviated as B) was used as a control antibody Purified antibodies were subjected to ELISA to evaluate their binding capacity to CD3 epsilon and human CD137 at same time.

First, a MyOne-T1 streptavidin beads were mixed with 0.625 pmol of biotin-labeled human CD137-Fc or biotin-labeled human Fc and incubated at room temperature for 10 minutes, then 2% skim-milk/TBS was added to block the magnetic beads. Mixed solution was dispended to each well of 96well plate (Corning, 3792 black round bottom PS plate) and incubated at room temperature for 60 minutes or more. After that magnetic beads were washed by TBS once. 100 ng of purified IgG was mixed with 62.5, 6.25 or 0.625 pmol of free CD3 epsilon peptide or 62.5 pmol of free human Fc or TBS and then added to the magnetic beads in each well, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL. A80-115AP) diluted with TBS was added to each well. The plate was incubated for one hour. After washing with TBST, APS-5 (Lumigen) was added to each well. 2 minutes later the fluorescence of each well was detected. The measurement results are shown in FIG. 10 and Table 5.

[Table 5]

TABLE 5

| | biotin-human CD137-Fc | | |
|---|---|---|---|
| | Free CD3e 62.5 pmol | Free Fc 62.5 pmol | Signal decrease |
| B | 182548 | 184279 | 0.94% |
| #001 | 15125 | 80997 | 81.33% |
| #002 | 9966 | 154791 | 93.56% |
| #018 | 9024 | 116919 | 92.28% |
| #019 | 12850 | 171835 | 92.52% |
| #051 | 10804 | 128260 | 91.58% |
| #094 | 9664 | 108313 | 91.08% |

Inhibition of binding to human CD137-Fc by free CD3 epsilon peptide was observed in all tested antibodies but not in control anti-CD137 antibody, and inhibition was not observed by free Fc domain. This results demonstrates those obtained antibodies could not bind to human CD137-Fc in the presence of CD3 epsilon peptide, in other words, these antibody do not bind to human CD137 and CD3 epsilon at same time. So it was proved that Fab domains which can bind to two different antigen, CD137 and CD3 epsilon, but not bind to at same time were successfully obtained with designed library and phage display double round selection.

[Reference Example 3] Obtainment of Fab Domain Binding to CD3 Epsilon, Human CD137 and Cyno CD137 from Dual Fab Library with Double Round Alternative Selection or Quadruple Round Selection 3.1. Panning Strategy to Improve the Efficiency to Obtain Fab Domain Binding to Cyno CD137

Fab domain binding to CD3 epsilon, human CD137 and cyno CD137 were successfully obtained in Reference Example 2, but binding to cyno CD137 was weaker than to human CD137. One of the considerable strategy to improve it is alternative panning with double round selection, in which different antigens would be used in different panning rounds. By this method selection pressure to both CD3 epsilon, human CD137 and cyno CD137 could be put on dual Fab library in each round with favorable antigen combination. CD3 epsilon with human CD137, CD3 epsilon with cyno CD137 or human CD137 with cyno CD137. And another strategy to improve it is the triple or quadruple round selection in which we can use all necessary antigens in one panning round.

In the double round selection procedure in Reference Example 2, over-night incubation was used to make antibody displaying phage transfer from $1^{st}$ antigen to $2^{nd}$ antigen. This methods worked well, but when affinity to $1^{st}$ antigen is stronger than to $2^{nd}$ antigen, transfer may be hardly occur (for example when $1^{st}$ antigen was CD3 epsilon in this dual library). To deal with this, elution of binding phage with base solution was also conducted. The campaign names and conditions of each panning procedure are described in Table 6.

Fab domains binding to CD3 epsilon, human CD137 and cyno CD137 were identified from the dual Fab library constructed in Reference Example 1.1. Biotin-labeled CD3 epsilon peptide antigen (amino acid sequence: SEQ ID NO: 86, CD3 epsilon peptide antigen biotin-labeled through disulfide-bond linker (C3NP1-27; amino acid sequence: SEQ ID NO: 194), heterodimer of biotin-labeled human CD3 epsilon fused to human IgG1 Fc fragment and biotin-labeled human CD3 delta fused to human IgG1 Fc fragment (named as CD3ed-Fc, amino acid sequence: SEQ ID NO: 95, 96), biotin-labeled human CD137 fused to human IgG1 Fc fragment (named as human CD137-Fc), biotin-labeled cynomolgus monkey CD137 fused to human IgG1 Fe fragment (named as cyno CD137-Fc) and biotin-labeled cynomolgus monkey CD137 (named as cyno CD137) was used as an antigen.

[Table 6]

TABLE 6

| Campaign | | | Cycle1 | | Cycle2 | | Cycle3 | | Cycle4 | |
|---|---|---|---|---|---|---|---|---|---|---|
| name | Round | panning | Antigen | Elution | Antigen | Elution | Antigen | Elution | Antigen | Elution |
| DU05 | Round 1 | Double | human CD137-Fc | IdeS | C3NP1-27 | DTT | | | | |
| | Round 2 | Double | cyno CD137-Fc | IdeS | C3NP1-27 | DTT | | | | |
| | Round 3 | Double | human CD137-Fc | IdeS | C3NP1-27 | DTT | | | | |
| | Round 4 | Double | cyno CD137-Fc | IdeS | C3NP1-27 | DTT | | | | |
| MP09 | Round 1 | Double | cyno CD137-Fc | IdeS | CD3ed-Fc | IdeS | | | | |
| | Round 2 | Double | human CD137-Fc | IdeS | cyno CD137 | Trypsin | | | | |
| | Round 3 | Quadraple | human CD137-Fc | IdeS | CD3ed-Fc | IdeS | cyno CD137-Fc | IdeS | CD3ed-Fc | IdeS |
| | Round 4 | Quadraple | cyno CD137-Fc | IdeS | CD3ed-Fc | IdeS | human CD137-Fc | IdeS | CD3ed-Fc | IdeS |
| MP11 | Round 1 | Double | cyno CD137-Fc | IdeS | CD3ed-Fc | IdeS | | | | |
| | Round 2 | Quadraple | human CD137-Fc | IdeS | CD3ed-Fc | IdeS | cyno CD137-Fc | IdeS | CD3ed-Fc | IdeS |
| | Round 3 | Quadraple | cyno CD137-Fc | IdeS | CD3ed-Fc | IdeS | human CD137-Fc | IdeS | CD3ed-Fc | IdeS |
| DS01 | Round 1 | Single | human CD137-Fc | Trypsin | | | | | | |
| | Round 2 | Double | CD3 peptide | TEA | human CD137-Fc | Trypsin | | | | |
| | Round 3 | Double | CD3 peptide | TEA | human CD137-Fc | Trypsin | | | | |
| | Round 4 | Double | CD3 peptide | TEA | cyno CD137-Fc | Trypsin | | | | |
| | Round 5 | Double | CD3 peptide | TEA | human CD137-Fc | Trypsin | | | | |
| | Round 6 | Double | CD3 peptide | TEA | cyno CD137-Fc | Trypsin | | | | |

3.2. Obtainment of Fab Domain Binding to CD3 Epsilon, Human CD137 and Cyno CD137 with Double Round Selection and Alternative Panning Panning condition named as campaign DU05 was conducted to obtain Fab domain binding to CD3 epsilon, human CD137 and cyno CD137 with double round selection and alternative panning as shown in Table 6.

Human CD137-Fc was used in even-numbered round and cyno CD137-Fc was used in odd-numbered round. Detailed panning procedure of double round selection was as same as it shown in Reference Example 2. In DUOS campaign, double round selection was conducted since the 18 round of panning.

3.3. Obtainment of Fab Domain Binding to CD3 Epsilon, Human CD137 and Cyno CD137 with Base-Elution Double Round Selection and Alternative Panning In previous double round selection with different antigens shown in Reference Example 2, antibody displaying phages were eluted as the complex with its 1$^{st}$ antigen because IdeS or DTT cleaved the linker region between antigen and biotin, so 1$^{st}$ antigen were also brought to the 2$^{nd}$ cycle of double round selection and compete with 2$^{nd}$ antigen. To suppress the carry-in of 1$^{st}$ antigen, elution with base buffer, which induce dissociation of binding antibodies from antigen and is very popular method in conventional phage display panning, was also conducted (name as campaign DS01).

Detailed panning procedure of panning round 1 was as same as it shown in Reference Example 2. In round1, conventional panning with biotin labeled human CD137-Fc was conducted.

In panning round1 Fab displaying phages which bind to human CD137 were accumulated so from panning round2 base-elution double round selection was conducted to obtain Fab domain which bind to CD3 epsilon, human CD137 and cyno CD137.

Specifically, at panning round2, magnetic beads was blocked by 2% skim-milk/TBS at room temperature for 60 minutes or more and washed three times with TBS. Phage solution were added to blocked magnetic beads and incubated at room temperature for 60 minutes or more, then superatant was recovered. 500 pmol of biotin labeled human IgG1 Fc was added to new magnetic beads and incubated at room temperature for 15 minutes and then add 2% skim-milk/TBS. After blocking at room temperature for 60 minutes or more, magnetic beads was washed three times with TBS. Recovered phage solution were added to blocked magnetic beads and incubated at room temperature for 60 minutes or more, then supernatant was recovered. 500 pmol of the biotin-labeled CD3 epsilon peptide was added to new magnetic beads and incubated at room temperature for 15 minutes and then add 2% skim-milk/TBS.

After blocking at room temperature for 60 minutes or more, magnetic beads was washed three times with TBS. Recovered phage solution were added to blocked magnetic beads and then incubated at room temperature for 60 minutes. The beads were washed three times with TBST (TBS containing 0.1% Tween 20; TBS was available from Takara Bio Inc.) and then further washed twice with 1 mL of TBS. 0.1 M Triethylamine (TEA, Wako 202-02646) was used to recover antibody displaying phages. In that procedure, 500 micro L of 0.1 M TEA was added and beads were suspended at room temperature for 10 minutes, immediately after which the beads were separated using a magnetic stand to recover phage solution. 100 micro L of IM Tris-HCl (pH 7.5) was added to neutralize phage solution for 15 minutes.

In this 1$^{st}$ cycle of panning procedure antibody displaying phages which bind to CD3 epsilon was concentrated so then move on to 2$^{nd}$ cycle panning procedure to recover antibody displaying phages which also bind to CD137 before phage infection and amplification. 500 pmol of the biotin-labeled human CD137-Fc was added to new magnetic beads and incubated at room temperature for 15 minutes and then add 2% skim-milk/TBS. After blocking at room temperature for 60 minutes or more, magnetic beads was washed three times with TBS. Recovered phage solution, 50 micro L of TBS and 250 micro L of 8% BSA blocking buffer were added to blocked magnetic beads and then incubated at room temperature for 60 minutes.

The beads were washed three times with TBST (TBS containing 0.1% Tween 20; TBS was available from Takara Bio Inc.) and then further washed twice with 1 mL of TBS. The beads supplemented with 0.5 ml of 1 mg/mL, trypsin were suspended at room temperature for 15 minutes, immediately after which the beads were separated using a magnetic stand to recover a phage solution. The phages recovered from the trypsin-treated phage solution were added to an *E. coli* strain ER2738 in a logarithmic growth phase (OD600: 0.4-0.7). The *E. coli* strain was infected by the phages through the gentle spinner culture of the strain at 37 degrees C., for 1 hour. The infected *E. coli* was inoculated to a plate of 225 mm×225 mm. Next, phages were recovered from the culture solution of the inoculated *E. coli* to recover a phage library solution.

In the 2$^{nd}$ cycle of double round selection in fourth and sixth round of panning, biotin labeled cyno CD137-Fc was used instead of biotin labeled human CD137-Fc. Through panning round4 to round6, 250 pmol of biotin labeled human or cyno CD137-Fc was used in the 2$^{nd}$ cycle of double round selection.

3.4. Obtainment of Fab Domain Binding to CD3 Epsilon, Human CD137 and Cyno CD137 with Quadruple Round Selection In previous double round selection only two different antigens could be used in the panning one round. To break through this limitation, quadruple round selection was also conducted (name as campaign MP09 and MP11, shown in Table 6).

In panning round1 of both MP09 and MP11 and panning round2 of MP09, double round selection was conducted.

Specifically, magnetic beads was blocked by 2% skim-milk/TBS at room temperature for 60 minutes or more and washed three times with TBS. Phage solution were added to blocked magnetic beads and incubated at room temperature for 60 minutes or more, then supernatant was recovered. 500 pmol of biotin labeled human IgG1 Fc was added to new magnetic beads and incubated at room temperature for 15 minutes and then add 2% skim-milk/TBS. After blocking at room temperature for 60 minutes or more, magnetic beads was washed three times with TBS. Recovered phage solution were added to blocked magnetic beads and incubated at room temperature for 60 minutes or more, then supernatant was recovered. 268 pmol of the biotin-labeled cyno CD137-Fc was added to new magnetic beads and incubated at room temperature for 15 minutes and then add 2% skim-milk/TBS.

After blocking at room temperature for 60 minutes or more, magnetic beads was washed three times with TBS.

Recovered phage solution were added to blocked magnetic beads and then incubated at room temperature for 60 minutes. The beads were washed three times with TBST (TBS containing 0.1% Tween 20; TBS was available from Takara Bio Inc.) and then further washed twice with 1 mL of TBS. FabRICATOR (IdeS, protease for hinge region of IgG, GENOVIS) (named as IdeS elution campaign) was used to recover antibody displaying phages. In that procedure, 10 units/micro L Fabricator 20 micro L with 80 micro L TBS buffer was added and beads were suspended at 37 degrees Celsius for 30 minutes, immediately after which the beads were separated using a magnetic stand to recover phage solution.

In this 1$^{st}$ cycle of panning procedure antibody displaying phages which bind to cyno CD137 was concentrated so then move on to 2$^{nd}$ cycle panning procedure to recover antibody displaying phages which also bind to CD3 epsilon before phage infection and amplification. To remove IdeS protease from phage solution, 40 micro L of helper phage M13KO7 (1.2E+13 pfu) and 200 micro L. of 10% PEG-2.5M NaCl was added and a pool of the phages thus precipitated was diluted with TBS to obtain a phage library solution. 500 pmol of the biotin-labeled CD3ed-Fc was added to new magnetic beads and incubated at room temperature for 15 minutes and then add 2% skim-milk/TBS. After blocking at room temperature for 60 minutes or more, magnetic beads was washed three times with TBS. Recovered phage solution and 500 micro L of 8% BSA blocking buffer were added to blocked magnetic beads and then incubated at room temperature for 60 minutes.

The beads were washed three times with TBST (TBS containing 0.1% Tween 20; TBS was available from Takara Bio Inc.) and then further washed twice with 1 mL of TBS. 10 units/micro L Fabricator 20 micro L with 80 micro L TBS buffer was added and beads were suspended at 37 degrees Celsius for 30 minutes, immediately after which the beads were separated using a magnetic stand to recover phage solution. 5 micro L of 100 mg/mL trypsin and 395 micro L of TBS were added and incubated at room temperature for 15 minutes. The phages recovered from the trypsin-treated phage solution were added to an *E. coli* strain ER2738 in a logarithmic growth phase (OD600: 0.4-0.7). The *E. coli* strain was infected by the phages through the gentle spinner culture of the strain at 37 degrees C., for 1 hour. The infected *E. coli* was inoculated to a plate of 225 mm×225 mm. Next, phages were recovered from the culture solution of the inoculated *E. coli* to recover a phage library solution.

In the second round of panning campaign of MP09, biotin-labeled human CD137-Fc was used as 1$^{st}$ cycle panning antigen and biotin-labeled cyno CD137 with elution by Trypsin was used as 2$^{nd}$ cycle panning antigen as shown in Table 6.

Quadruple panning was conducted in panning round3 and round4 of MP09 campaign and panning round2 and round3 of MP11 campaign.

In panning round3 of MP09 and round2 of MP11 campaign, magnetic beads was blocked by 2% skim-milk/TBS at room temperature for 60 minutes or more and washed three times with TBS. Phage solution were added to blocked magnetic beads and incubated at room temperature for 60 minutes or more, then supernatant was recovered. 500 pmol of biotin labeled human IgG1 Fc was added to new magnetic beads and incubated at room temperature for 15 minutes and then add 2% skim-milk/TBS. After blocking at room temperature for 60 minutes or more, magnetic beads was washed three times with TBS. Recovered phage solution were added to blocked magnetic beads and incubated at room temperature for 60 minutes or more, then supernatant was recovered. 250 pmol of the biotin-labeled human CD137-Fc was added to new magnetic beads and incubated at room temperature for 15 minutes and then add 2% skim-milk/TBS.

After blocking at room temperature for 60 minutes or more, magnetic beads was washed three times with TBS. Recovered phage solution were added to blocked magnetic beads and then incubated at room temperature for 60 minutes. The beads were washed three times with TBST (TBS containing 0.1% Tween 20; TBS was available from Takara Bio Inc.) and then further washed twice with 1 mL of TBS. FabRICATOR (IdeS, protease for hinge region of IgG. GENOVIS) (named as IdeS elution campaign) was used to recover antibody displaying phages. In that procedure, 10 units/micro L Fabricator 20 micro L with 80 micro L TBS buffer was added and beads were suspended at 37 degrees Celsius for 30 minutes, immediately after which the beads were separated using a magnetic stand to recover phage solution.

To remove IdeS protease from phage solution, 40 micro L of helper phage M13KO7 (1.2E+13 pfu) and 200 micro L of 10% PEG-2.5M NaCl was added and a pool of the phages thus precipitated was diluted with TBS to obtain a phage library solution. 250 pmol of the biotin-labeled CD3ed-Fc was added to new magnetic beads and incubated at room temperature for 15 minutes and then add 2% skim-milk/TBS. After blocking at room temperature for 60 minutes or more, magnetic beads was washed three times with TBS. Recovered phage solution and 500 micro L of 8% BSA blocking buffer were added to blocked magnetic beads and then incubated at room temperature for 60 minutes. The beads were washed three times with TBST (TBS containing 0.1% Tween 20; TBS was available from Takara Bio Inc.) and then further washed twice with 1 mL of TBS. 10 units/micro L Fabricator 20 micro L with 80 micro L TBS buffer was added and beads were suspended at 37 degrees Celsius for 30 minutes, immediately after which the beads were separated using a magnetic stand to recover phage solution.

In 3$^{rd}$ cycle of quadruple round selection, 40 micro L of helper phage M13KO7 (1.2E+13 pfu) and 200 micro L of 10% PEG-2.5M NaCl was added and a pool of the phages thus precipitated was diluted with TBS to obtain a phage library solution. 250 pmol of the biotin-labeled cyno CD137-Fc was added to new magnetic beads and incubated at room temperature for 15 minutes and then add 2% skim-milk/TBS. After blocking at room temperature for 60 minutes or more, magnetic beads was washed three times with TBS. Recovered phage solution and 500 micro L of 8% BSA blocking buffer were added to blocked magnetic beads and then incubated at room temperature for 60 minutes. The beads were washed three times with TBST (TBS containing 0.1% Tween 20; TBS was available from Takara Bio Inc.) and then further washed twice with 1 mL of TBS. 10 units/micro L Fabricator 20 micro L with 80 micro L TBS buffer was added and beads were suspended at 37 degrees Celsius for 30 minutes, immediately after which the beads were separated using a magnetic stand to recover phage solution.

In 4$^{th}$ cycle of quadruple round selection, 40 micro L of helper phage M13KO7 (1.2E+13 pfu) and 200 micro L of 10% PEG-2.5M NaCl was added and a pool of the phages thus precipitated was diluted with TBS to obtain a phage library solution. 500 pmol of the biotin-labeled CD3ed-Fc was added to new magnetic beads and incubated at room temperature for 15 minutes and then add 2% skim-milk/

TBS. After blocking at room temperature for 60 minutes or more, magnetic beads was washed three times with TBS. Recovered phage solution and 500 micro L of 8% BSA blocking buffer were added to blocked magnetic beads and then incubated at room temperature for 60 minutes.

The beads were washed three times with TBST (TBS containing 0.1% Tween 20; TBS was available from Takara Bio Inc.) and then further washed twice with 1 mL of TBS. 10 units/micro L Fabricator 20 micro L with 80 micro L. TBS buffer was added and beads were suspended at 37 degrees Celsius for 30 minutes, immediately after which the beads were separated using a magnetic stand to recover phage solution. 5 micro L of 100 mg/mL trypsin and 395 micro L of TBS were added and incubated at room temperature for 15 minutes. The phages recovered from the trypsin-treated phage solution were added to an *E. coli* strain ER2738 in a logarithmic growth phase (OD600: 0.4-0.7) The *E. coli* strain was infected by the phages through the gentle spinner culture of the strain at 37 degrees C., for 1 hour. The infected *E. coli* was inoculated to a plate of 225 mm×225 mm. Next, phages were recovered from the culture solution of the inoculated *E. coli* to recover a phage library solution.

In panning round4 of MP09 and round3 of MP11 campaign, biotin labeled human CD137-Fc was used as 1$^{st}$ cycle antigen and biotin labeled cyno CD137-Fc was used as 3$^{rd}$ cycle antigen.

3.5. Binding of Fab Domain Displayed by Phage to Human and Cyno CD137 (Phage ELISA)

Fab displaying phage solution were prepared through panning procedure in Reference Example 3.2, 3.3 and 3.4. First, 20 micro g of Streptavidin-coated magnetic beads MyOne-T1 beads was washed three-times with blocking buffer including 0.4% block Ace, 1% BSA, 0.02% Tween and 0.05% ProClin 300 and then blocked with this blocking buffer at room temperature for 60 minutes or more. After washing once with TBST, magnetic beads were applied to each well of 96well plate (Corning, 3792 black round bottom PS plate) and 0.625 pmol of biotin labeled human CD137-Fc, biotin labeled cyno CD137-Fc or biotin labeled CD3 epsilon peptide was added to magnetic beads and incubated at room temperature for 15 minutes or more.

After washing once with TBST, 250 nL each of the Fab displaying phage solution with 24.75 micro L of TBS was added to the wells, and the plate was allowed to stand at room temperature for one hour to allow each Fab to bind to biotin-labeled antigen in each well. After that each well was washed with TBST. Anti-M13(p8) Fab-HRP diluted with TBS was added to each well. The plate was incubated for 10 minutes. After washing with TBST, LumiPhos-HRP (Lumigen) was added to each well. 2 minutes later the fluorescence of each well was detected. The measurement results are shown in FIG. 11.

The binding to each antigens, human CD137, cyno CD137 and CD3 epsilon, were observed in each panning output phage solution. This result showed that double round selection with base elution worked as well as previous double round selection with Ides elution method, and that double round selection with alternative panning also worked well to obtain Fab domain which bind to three different antigens. Nonetheless the binding to cyno CD137 was still weak compared to human CD137 although these methods collect Fab domains which bind to three different antigens. On the other hand, in MP09 or MP11 campaign, the binding to CD3 epsilon, human CD137 and cyno CD137 were observed at same round point and their binding to cyno CD137 was higher than other campaign. This result demonstrated that quadruple round selection can concentrate Fab domain which bind to three different antigens more efficiently.

3.6. Preparation of IgG Having Obtained Fab Domain 96 clones were picked from each panning output pools and their VH gene sequence were analyzed. Thirty-two clones were selected because their VH sequence were appeared more than twice among all analyzed pools. Their VH gene were amplified by PCR and converted into IgG format. The VH fragments of each clones were amplified by PCR using primers specifically binding to the H chain in the library (SEQ ID NOs: 196 and 197). The amplified VH fragment was integrated into an animal expression plasmid which have already had human IgG1 CH1-Fc region. The prepared plasmids were used for expression in animal cells by the method of Reference Example 9 These sample were called as clone converted IgG. GLS3000 was used as Light chain.

VH genes of each panning output pools were also converted into IgG format. Phagemid vector library were prepared from the *E. coli* of each panning output pools DU05, DS01 and MP11, and digested with NheI and SalI restriction enzyme to extract VH genes directly. The extracted VH fragments were integrated into an animal expression plasmid which have already had human IgG1 CH1-Fc region. The prepared plasmids were introduced into *E. coli* and 192 or 288 colonies were picked from each panning output pools and their VH sequence were analyzed. In MP09 and 11 campaign, clones which had different VH sequences were picked up as possible. The prepared plasmids from each *E. coli* colonies were used for expression in animal cells by the method of Reference Example 9. These sample were called as bulk converted IgG. GLS3000 was used as Light chain.

3.7. Assessment of the Obtained Antibodies for their CD3 Epsilon, Human CD137 and Cyno CD137 Binding Activity The prepared bulk converted IgG antibodies were subjected to ELISA to evaluate their binding capacity to CD3 epsilon, human CD137 and cyno CD137.

First, a Streptavidin-coated microplate (384 well, Greiner) was coated with 20 micro L of TBS containing biotin-labeled CD3 epsilon peptide, biotin labeled human CD137-Fc or biotin labeled cyno CD137-Fc at room temperature for one or more hours. After removing biotin-labeled antigen that are not bound to the plate by washing each well of the plate with TBST, the wells were blocked with 20 micro L of Blocking Buffer (2% skim milk/TBS) for one or more hours. Blocking Buffer was removed from each well. 20 micro L each of the IgG containing mammalian cell supernatant twice diluted with 2% Skim milk/TBS were added to the wells, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL. A80-115AP) diluted with TBS was added to each well. The plate was incubated for one hour. After washing with TBST, the chromogenic reaction of the solution in each well added with Blue Phos Microwell Phosphatase Substrate System (KPL) was terminated by adding Blue Phos Stop Solution (KPL). Then, the color development was measured by absorbance at 615 nm. The measurement results are shown in FIG. 12.

Many IgG clones which showed binding to both CD3 epsilon, human CD137 and cyno CD137 were obtained from each panning procedure so it proves that both double round selection with alternative panning, double selection with base elution and quadruple round selection were all worked as expected. Especially, Most of all clones from quadruple round selection which bound to human CD137 showed equality level of binding to cyno-CD137 compared to other two panning conditions. In those panning conditions it was likely to be obtained less clones which showed binding to both CD3 epsilon and human CD137, it mainly because clones which had same VH sequences each other were not picked up on purpose as possible in this campaign. Fifty-four clones which showed better binding to each protein and had different VH sequences each other were selected and evaluated further.

3.8. Assessment of the Purified IgG Antibodies for their CD3 Epsilon, Human CD137 and Cyno CD137 Binding Activity The binding capability of purified IgG antibodies were evaluated. Thirty-two clone converted IgGs in Reference Example 3.5 and fifty-four bulk converted IgGs which was selected in Reference Example 3.6 were used.

First, 20 micro g of Streptavidin-coated magnetic beads MyOne-T1 beads was washed three-times with blocking buffer including 0.4% block Ace, 1% BSA, 0.02% Tween and 0.05% ProClin 300 and then blocked with this blocking buffer at room temperature for 60 minutes or more. After washing once with TBST, magnetic beads were applied to each well of white round bottom PS plate (Corning, 3605) and 0.625 pmol of biotin labeled CD3 epsilon peptide, 2.5 pmol of biotin labeled human CD137-Fc, 2.5 pmol of biotin labeled cyno CD137-Fc or 0.625 pmol of biotin labeled human Fc was added to magnetic beads and incubated at room temperature for 15 minutes or more.

After washing once with TBST, 25 micro L each of the 50 ng/micro L purified IgG was added to the wells, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL, A80-115AP) diluted with TBS was added to each well. The plate was incubated for one hour. After washing with TBST, each sample were transferred to 96well plate (Corning, 3792 black round bottom PS plate) and APS-S(Lumigen) was added to each well. 2 minutes later the fluorescence of each well was detected. The measurement results are shown in FIG. 13. Many clones showed equal level of binding to both human and cyno CD137 and also showed binding to CD3 epsilon.

3.9. Evaluation of Binding of IgG Having Obtained Fab Domain to CD3 Epsilon and Human CD137 at Same Time Thirty-seven antibodies which showed obvious binding to both CD3 epsilon, human CD137 and cyno CD137 in Reference Example 3.7 were selected to evaluate further. Seven antibodies obtained in Reference Example 2.3 were also evaluated (these 7 clones were renamed as in Table 7). Purified antibodies were subjected to ELISA to evaluate their binding capacity to CD3 epsilon and human CD137 at same time. Anti-human CD137 antibody named as B described in Reference Example 2.5 was used as control antibody,

TABLE 7

| Old name | New name |
|---|---|
| DXDU01 3 #094 | dBBDu121 |
| DXDU01 3 #072 | dBBDu122 |
| DADU01 3 #018 | dBBDu123 |
| DADU01 3 #002 | dBBDu124 |
| DXDU01 3 #019 | dBBDu125 |
| DADU01 3 #001 | dBBDu126 |
| DXDU01 3 #051 | IdBBDu127 |

First, 20 micro g of Streptavidin-coated magnetic beads MyOne-T1 beads was washed three-times with blocking buffer including 0.4% block Ace, 1% BSA, 0.02% Tween and 0.05% ProClin 300 and then blocked with this blocking buffer at room temperature for 60 minutes or more. After washing once with TBST, magnetic beads were applied to each well of black round bottom PS plate (Corning, 3792). 1.25 pmol of biotin-labeled human CD137-Fc was added and incubated at room temperature for 10 minute. After that magnetic beads were washed by TBS once. 1250 ng of purified IgG was mixed with 125, 12.5 or 1.25 pmol of free CD3 epsilon peptide or TBS and then added to the magnetic beads in each well, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL, A80-115AP) diluted with TBS was added to each well. The plate was incubated for 10 minutes. After washing with TBST. APS-S (Lumigen) was added to each well. 2 minutes later the fluorescence of each well was detected. The measurement results are shown in FIG. 14 and Table 8.

TABLE 8

| | biotin-human CD137-Fc | | |
|---|---|---|---|
| | free CD3e (pmol/well) | | Signal |
| | 0 | 125 | decrease |
| dBBDu133 | 16927 | 2373 | 85.98% |
| dBBDu139 | 9436 | 1924 | 79.61% |
| dBBDu140 | 19960 | 1923 | 90.37% |
| dBBDu142 | 13665 | 1786 | 86.93% |
| dBBDu149 | 3915 | 1962 | 49.89% |
| dBBDu165 | 75488 | 1954 | 97.41% |
| dBBDu167 | 25731 | 1937 | 92.47% |
| dBBDu171 | 7394 | 1819 | 75.40% |
| dBBDu172 | 7589 | 2241 | 70.47% |
| dBBDu173 | 6544 | 2041 | 68.81% |
| dBBDu178 | 6777 | 2126 | 68.63% |
| dBBDu179 | 61009 | 2625 | 95.70% |
| dBBDu181 | 3241 | 1990 | 38.60% |
| dBBDu182 | 9081 | 2178 | 76.02% |
| dBBDu183 | 34000 | 2369 | 93.03% |
| dBBDu184 | 16701 | 1888 | 88.70% |
| dBBDu186 | 34783 | 2497 | 92.82% |
| dBBDu189 | 27434 | 2193 | 92.01% |
| dBBDu191 | 12863 | 2230 | 82.66% |
| dBBDu193 | 18193 | 2278 | 87.48% |
| dBBDu195 | 9715 | 2361 | 75.70% |
| dBBDu196 | 33099 | 2222 | 93.29% |
| dBBDu197 | 54367 | 2111 | 96.12% |
| dBBDu199 | 40880 | 2372 | 94.20% |
| dBBDu202 | 12055 | 1930 | 83.99% |
| dBBDu204 | 43663 | 1879 | 95.70% |

TABLE 8-continued

| | biotin-human CD137-Fc | | |
|---|---|---|---|
| | free CD3e (pmol/well) | | Signal |
| | 0 | 125 | decrease |
| dBBDu205 | 45191 | 2194 | 95.15% |
| dBBDu206 | 6967 | 1697 | 75.64% |
| dBBDu207 | 7466 | 1844 | 75.30% |
| dBBDu209 | 12051 | 1779 | 85.24% |
| dBBDu211 | 7284 | 1732 | 76.22% |
| dBBDu214 | 12852 | 1701 | 86.76% |
| dBBDu217 | 19093 | 2416 | 87.35% |
| dBBDu222 | 7188 | 3236 | 54.98% |
| dBBDu166 | 3437 | 1844 | 46.35% |
| dBBDu174 | 4804 | 1884 | 60.78% |
| dBBDu175 | 3257 | 1755 | 46.12% |
| dBBDu121 | 3609 | 1826 | 49.40% |
| dBBDu122 | 2698 | 1882 | 30.24% |
| dBBDu123 | 2746 | 1840 | 32.99% |
| dBBDu124 | 6621 | 2116 | 68.04% |
| dBBDu125 | 61364 | 2058 | 96.65% |
| dBBDu126 | 116289 | 2613 | 97.75% |
| dBBDu127 | 3232 | 2198 | 31.99% |
| Du115/DUL008 | 86183 | 2620 | 96.96% |
| Du103/DUL050 | 5273 | 5297 | −0.46% |
| B | 99359 | 98110 | 1.26% |
| blank | 1860 | 1850 | 0.54% |

The binding to human CD137 of all tested clones except for control anti-CD137 antibody B was inhibited by excess amount of free CD3 epsilon peptide, it demonstrated that obtained antibodies with dual Fab library did not bind to CD3 epsilon and human CD137 at same time.

3.10. Evaluation of the Human CD137 Epitope of IgGs Having Obtained Fab Domain to CD3 Epsilon and Human CD137

Twenty-one antibodies in Reference Example 3.8 were selected to evaluate further (Table 10). Purified antibodies were subjected to ELISA to evaluate their binding epitope of human CD137.

To analyze the epitope, a fusion protein of the fragmentation human CD137 and the Fc region of an antibody that domain divided by the structure formed by Cys-Cys called CRD reference (Table 9) as described in WO2015/156268. Fragmentation human CD137-Fc fusion protein to include the amino acid sequence shown in Table 9, the respective gene fragments by PCR from a polynucleotide encoding the full-length human CD137-Fc fusion protein (SEQ ID NO: 90) It Gets, incorporated into a plasmid vector for expression in animal cells by methods known to those skilled in the art. Fragmentation human CD137-Fc fusion protein was purified as an antibody by the method described in WO2015/156268.

TABLE 9

| Name of the fragmented human CD137 | Amino acid sequence of the fragmented human CD137 | Domains that are included | SEQ ID NO |
|---|---|---|---|
| Full length | LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ | CRD1, 2, 3, 4 | 90 |
| CRD1 | LQDPCSNCPAGTFCDNNRNQIC | CRD1 | 147 |
| CRD2 | SPCPPNSFSSAGGQRTCDICRQCKGVFRTRKECSSTSNAEC | CRD2 | 148 |
| CRD3 | DCTPGFHCLGAGCSMCEQDCKQGQELTKKGC | CRD3 | 149 |
| CRD4 | KDCCFGTFNDQKRGICRPWTNCSLDGKSVLVNGTKERDVVCGPSPADLSPGASSVTPPAPAREPGHSPQ | CRD4 | 150 |
| CRD1-3 | LQDPCSNCPAGTFCDNNRNQICSPCPPNSFSSAGGQRTCDICRQCKGVFRTRKECSSTSNAECDCTPGFHCLGAGCSMCEQDCKQGQELTKKGC | CRD1, 2, 3 | 151 |
| CRD1-2 | LQDPCSNCPAGTFCDNNRNQICSPCPPNSFSSAGGQRTCDICRQCKGVFRTRKECSSTSNAEC | CRD1, 2 | 152 |
| CRD2-4 | SPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ | CRD2, 3, 4 | 153 |
| CRD2-3 | SPCPPNSFSSAGGQRTCDICRQCKGVFRTRKECSSTSNAECDCTPGFHCLGAGCSMCEQDCKQGQELTKKGC | CRD2, 3 | 154 |
| CRD3-4 | DCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ | CRD3, 4 | 155 |

First, 20 micro g of Streptavidin-coated magnetic beads MyOne-T1 beads was washed three-times with blocking buffer including 0.4% block Ace, 1% BSA, 0.02% Tween and 0.05% ProClin 300 and then blocked with this blocking buffer at room temperature for 60) minutes or more. After washing once with TBST, magnetic beads were applied to each well of black round bottom PS plate (Corning, 3792), 1.25 pmol of biotin-labeled human CD137-Fc, human CD137 domain 1-Fc, human CD137 domain 1/2-Fc, human CD137 domain2/3-Fc, human CD137 domain2/3/4-Fc, human CD137 domain3/4-Fc and human Fc was added and incubated at room temperature for 10 minute. After that magnetic beads were washed by TBS once, 1250 ng of purified IgG was added to the magnetic beads in each well, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL, A80-115AP) diluted with TBS was added to each well. The plate was incubated for 10 minutes. After washing with TBST, APS-5 (Lumigen) was added to each well. 2 minutes later the fluorescence of each well was detected. The measurement results are shown in FIG. 15.

Each clones recognized different epitope domain of human CD137. Antibodies which recognize only domain 1/2 (e.g, dBBDu183, dBBDu205), both domain 1/2 and domain2/3 (e.g, dBBDu193, dBBDu 202, dBBDu222), both domain2/3, 2/3/4 and 3/4 (e.g, dBBDu139, dBBDu217), broadly human CD137 domains (dBBDu174) and which do not bind to each separated human CD137 domains (e.g, dBBDu126). This result demonstrates many dual binding antibodies to several human CD137 epitopes can be obtained with this designed library and double round selection procedure.

The practice epitope region of dBBDu126 cannot be decided by this ELISA assay, but it can be guessed that it will recognize position(s) in which human and cynomolgus monkey have different residues because dBBDu126 cannot cross-react with cyno CD137 as described in Reference Example 2.3. As shown in FIG. 7, there are 8 different position between human and cyno, and 75E (75G in human) was identified as occasion which interfere the binding of dBBDu126 to cyno CD137 by the binding assay to cyno CD137/human CD137 hybrid molecules and the crystal structure analysis of binding complex. Crystal structure also reveal dBBDu126 mainly recognize CRD3 region of human CD137.

TABLE 10

| Clone name | SEQ ID NO |
|---|---|
| dBBDu126 | 102 |
| dBBDu183 | 104 |
| dBBDu179 | 105 |
| dBBDu196 | 106 |
| dBBDu197 | 107 |
| dBBDu199 | 108 |
| dBBDu204 | 109 |
| dBBDu205 | 110 |
| dBBDu193 | 111 |
| dBBDu217 | 112 |
| dBBDu139 | 113 |
| dBBDu189 | 114 |
| dBBDu167 | 115 |
| dBBDu173 | 116 |
| dBBDu174 | 117 |
| dBBDu181 | 118 |
| dBBDu186 | 119 |
| dBBDu191 | 120 |

TABLE 10-continued

| Clone name | SEQ ID NO |
|---|---|
| dBBDu202 | 121 |
| dBBDu222 | 122 |
| dBBDu125 | 101 |

[Reference Example 4] Affinity Maturation of Antibody Domain Binding to CD3 Epsilon and Human CD137 from Dual Fab Library with Designed Light Chain Library

4.1. Construction of Light Chain Library with Obtained Heavy Chain

Many antibodies which bind to both CD3 epsilon and human CD137 were obtained in Reference Example 3, but their affinity to human CD137 were still weak so affinity maturation to improve their affinity was conducted.

Thirteen VH sequences, dBBDu_179, 183, 196, 197, 199, 204, 205, 167, 186, 189, 191, 193 and 222 were selected for affinity maturation. In those, dBBDu 179, 183, 196, 197, 199, 204 and 205 have same CDR3 sequence and different CDR1 or 2 sequences so these 7 phagemids were mixed to produce Light chain Fab library, dBBDu 191, 193 and 222 three phagemids were also mixed to produce Light chain Fab library although they had different CDR3 sequences. The list of light chain library was shown in Table 11.

TABLE 11

| Library name | VH |
|---|---|
| Library 2 | dBBDu_179, 183, 196, 197, 199, 204, 205 |
| Library 3 | dBBDu_167 |
| Library 4 | dBBDu_186 |
| Library 5 | dBBDu_189 |
| Library 6 | dBBDu_191, 193, 222 |

The synthesized antibody VL library fragments described in Reference Example 12 were amplified by PCR method with the primers of SEQ ID NO: 198 and 199. Amplified VL fragments were digested by SfiI and KpnI restriction enzyme and introduced into phagemid vectors which had each thirteen VH fragments. The constructed phagemids for phage display were transferred to *E. coli* by electroporation to prepare *E. coli* harboring the antibody library fragments.

Phage library displaying Fab domain were produced from the *E. coli* harboring the constructed phagemids by infection of helper phage M13KO7TC/FkpA which code FkpA chaperone gene and then incubation with 0.002% arabinose at 25 degrees Celsius for overnight. M13KO7TC is a helper phage which has an insert of the trypsin cleavage sequence between the N2 domain and the CT domain of the pIII protein on the helper phage (see Japanese Patent Application Kohyo Publication No. 2002-514413). Introduction of insert gene into M13KO7TC gene have been already disclosed elsewhere (see WO2015/046554).

4.2. Obtainment of Fab Domain Binding to CD3 Epsilon and Human CD137 with Double Round Selection Fab domains binding to CD3 epsilon, human CD137 and cyno CD137 were identified from the dual Fab library constructed in Reference Example 4.1, CD3 epsilon peptide antigen biotin-labeled through disulfide-bond linker (C3NP1-27), biotin-labeled human CD137 fused to human IgG1 Fc fragment (named as human CD137-Fc) and biotin-labeled cynomolgus monkey CD137 fused to human IgG1 Fc fragment (named as cyno CD137-Fc) was used as an antigen.

Phages were produced from the *E. coli* harboring the constructed phagemids for phage display. 2.5 M NaCl/10% PEG was added to the culture solution of the *E. coli* that had produced phages, and a pool of the phages thus precipitated was diluted with TBS to obtain a phage library solution. Next. BSA (final concentration: 4%) was added to the phage library solution. The panning method was performed with reference to a general panning method using antigens immobilized on magnetic beads (J. Immunol. Methods. (2008) 332 (1-2), 2-9: J. Immunol. Methods. (2001) 247 (1-2), 191-203; Biotechnol. Prog. (2002) 18 (2) 212-20; and Mol. Cell Proteomics (2003) 2 (2), 61-9). The magnetic beads used were NeutrAvidin coated beads (Sera-Mag SpeedBeads NeutrAvidin-coated) or Streptavidin coated beads (Dynabeads M-280 Streptavidin).

Specifically. Phage solution was mixed with 100 pmol of human CD137-Fc and 4 nmol of free human IgG1 Fc domain and incubated at room temperature for 60 minutes.

Magnetic beads was blocked by 2% skim-milk/TBS with free Streptavidin (Roche) at room temperature for 60 minutes or more and washed three times with TBS, and then mixed with incubated phage solution. After incubation at room temperature for 15 minutes, the beads were washed three-times with TBST (TBS containing 0.1% Tween 20; TBS was available from Takara Bio Inc.) for 10 minutes and then further washed twice with 1 mL of TBS for 10 minutes. FabRICATOR (IdeS, protease for hinge region of IgG. GENOVIS) (named as IdeS elution campaign) was used to recover antibody displaying phages.

In that procedure, 10 units/micro L Fabricator 20 micro L with 80 micro L TBS buffer was added and beads were suspended at 37 degrees Celsius for 30 minutes, immediately after which the beads were separated using a magnetic stand to recover phage solution. 5 micro L of 100 mg/mL Trypsin and 400 micro L of TBS were added and incubated at room temperature for 15 minutes. The recovered phage solution was added to an *E. coli* strain ER2738 in a logarithmic growth phase (OD600: 0.4-0.5). The *E. coli* strain was infected by the phages through the gentle spinner culture of the strain at 37 degrees C. for 1 hour. The infected *E. coli* was inoculated to a plate of 225 mm×225 mm. Next, phages were recovered from the culture solution of the inoculated *E. coli* to prepare a phage library solution.

In this panning round 1 procedure antibody displaying phages which bind to human CD137 was concentrated. In the $2^{nd}$ round of panning, 160 pmol of C3NP1-27 was used as biotin-labeled antigen and wash was conducted seven-times with TBST for 2 minutes and then three-times with TBS for 2 minutes. Elution was conducted with 25 mM DTT at room temperature for 15 minutes and then digested by Trypsin.

In the $3^{rd}$ round of panning, 16 or 80 pmol of biotin-labeled cyno CD137-Fc were used as antigen and wash was conducted seven-times with TBST for 10 minutes and then three-times with TBS for 10 minutes. Elution was conducted with IdeS as same as round1.

In the $4^{th}$ round of panning, 16 or 80 pmol of biotin labeled human CD137-Fc were used as antigen and wash was conducted seven-times with TBST for 10 minutes and then three-times with TBS for 10 minutes. Elution was conducted with IdeS as same as round1.

4.3. Binding of IgG Having Obtained Fab Domain to Human CD137 and Cyno CD137

Fab genes of each panning output pools were converted into IgG format. The prepared mammalian expression plasmids were introduced into *E. coli* and 96 colonies were picked from each panning output pools and their VH and VL sequence were analyzed. Most of VH sequence in Library 2 had concentrated to dBBDu_183 and most of VH sequence in Library6 had concentrated to dBBDu_193, respectively. The prepared plasmids from each *E. coli* colonies were used for expression in animal cells by the method of Reference Example 9.

The prepared IgG antibodies were subjected to ELISA to evaluate their binding capacity to CD3 epsilon, human CD137 and cyno CD137.

First, a Streptavidin-coated microplate (384 well, Greiner) was coated with 20 micro L of TBS containing biotin-labeled CD3 epsilon peptide, biotin labeled human CD137-Fc or biotin labeled cyno CD137-Fc at room temperature for one or more hours. After removing biotin-labeled antigen that are not bound to the plate by washing each well of the plate with TBST, the wells were blocked with 20 micro L of Blocking Buffer (2% skim milk/TBS) for one or more hours. Blocking Buffer was removed from each well. 20 micro L each of the 10 ng/micro L IgG containing mammalian cell supernatant twice diluted with 1% Skim milk/TBS were added to the wells, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL, A80-115AP) diluted with TBS was added to each well. The plate was incubated for one hour. After washing with TBST, the chromogenic reaction of the solution in each well added with Blue Phos Microwell Phosphatase Substrate System (KPL) was terminated by adding Blue Phos Stop Solution (KPL) Then, the color development was measured by absorbance at 615 nm. The measurement results are shown in FIG. 16.

Many IgG clones which showed binding to both CD3 epsilon, human CD137 and cyno CD137 were obtained from each panning procedure. Ninety-six clones which showed better binding were selected and evaluated further.

4.4. Evaluation of Binding of IgG Having Obtained Fab Domain to CD3 Epsilon and Human CD137 at Same Time Ninety-six antibodies which showed obvious binding to both CD3 epsilon, human CD137 and cyno CD137 in Reference Example 4.3 were selected to evaluate further. Purified antibodies were subjected to ELISA to evaluate their binding capacity to CD3 epsilon and human CD137 at same time.

First, 20 micro g of Streptavidin-coated magnetic beads MyOne-T1 beads was washed three-times with blocking buffer including 0.5× block Ace, 0.02% Tween and 0.05% ProClin 300 and then blocked with this blocking buffer at room temperature for 60 minutes or more. After washing once with TBST, magnetic beads were applied to each well of black round bottom PS plate (Corning, 3792). 0.625 pmol of biotin-labeled human CD137-Fc was added and incubated at room temperature for 10 minute. After that magnetic beads were washed by TBS once. 250 ng of purified IgG was mixed with 62.5, 6.25 or 0.625 pmol of free CD3 epsilon or 62.5 pmol of free human IgG1 Fc domain and then added to the magnetic beads in each well, and the plate was allowed to stand at room temperature for one hour to allow each IgG to bind to biotin-labeled antigen in each well. After that each well was washed with TBST. Goat anti-human kappa Light chain alkaline phosphatase conjugate (BETHYL, A80-115AP) diluted with TBS was added to each well. The plate was incubated for 10 minutes. After washing with TBST, APS-5 (Lumigen) was added to each well. 2 minutes later the fluorescence of each well was detected. The measurement results are shown in FIG. 17 and Table 12. The binding to human CD137 of most tested clones was inhibited by excess amount of free CD3 epsilon peptide, it demonstrated that obtained antibodies with dual Fab library did not bind to CD3 epsilon and human CD137 at same time.

TABLE 12

| | biotin-human CD137-Fc | | |
|---|---|---|---|
| | Free CD3e 62.5 pmol | Free Fc 62.5 pmol | Signal decrease |
| dBBDu183/L057 | 2732 | 9025 | 69.73% |
| dBBDu183/L058 | 2225 | 11115 | 79.98% |
| dBBDu183/L059 | 2134 | 100126 | 97.87% |
| dBBDu183/L060 | 2169 | 37723 | 94.25% |
| dBBDu183/L061 | 2118 | 2723 | 22.22% |
| dBBDu183/L062 | 2777 | 27880 | 90.04% |
| dBBDu183/L063 | 2943 | 28858 | 89.80% |
| dBBDu183/L064 | 2206 | 13474 | 83.63% |
| dBBDu183/L065 | 2725 | 6024 | 54.76% |
| dBBDu183/L066 | 2325 | 34020 | 93.17% |
| dBBDu183/L067 | 2936 | 19722 | 85.11% |
| dBBDu197/L068 | 2786 | 105219 | 97.35% |
| dBBDu183/L069 | 2463 | 31769 | 92.25% |
| dBBDu183/L070 | 3267 | 92395 | 96.46% |
| dBBDu183/L071 | 2297 | 8670 | 73.51% |
| dBBDu183/L072 | 2840 | 54764 | 94.81% |
| dBBDu183/L073 | 2876 | 6724 | 57.23% |
| dBBDu196/L074 | 2724 | 12891 | 78.87% |
| dBBDu183/L075 | 2568 | 8029 | 68.02% |
| dBBDu196/L076 | 2188 | 5037 | 56.56% |
| dBBDu179/L077 | 3147 | 8018 | 60.75% |
| dBBDu167/L078 | 2378 | 27120 | 91.23% |
| dBBDu167/L079 | 2269 | 5869 | 61.34% |
| dBBDu167/L080 | 2236 | 95870 | 97.67% |
| dBBDu167/L081 | 2508 | 44240 | 94.33% |
| dBBDu167/L082 | 2398 | 177750 | 98.65% |
| dBBDu167/L083 | 2164 | 78935 | 97.26% |
| dBBDu167/L084 | 2182 | 18392 | 88.14% |
| dBBDu167/L085 | 2202 | 8724 | 74.76% |
| dBBDu167/L086 | 2627 | 135762 | 98.06% |
| dBBDu167/L087 | 2168 | 106703 | 97.97% |
| dBBDu167/L088 | 2040 | 2163 | 5.69% |
| dBBDu167/L089 | 2424 | 10161 | 76.14% |
| dBBDu167/L090 | 2595 | 181795 | 98.57% |
| dBBDu167/L091 | 11345 | 124409 | 90.88% |
| dBBDu167/L092 | 2924 | 123122 | 97.63% |
| dBBDu167/L093 | 4934 | 139388 | 96.46% |
| dBBDu167/L094 | 4374 | 140938 | 96.90% |
| dBBDu167/L095 | 2207 | 112225 | 98.03% |
| dBBDu186/L096 | 37273 | 84887 | 56.09% |
| dBBDu186/L097 | 9006 | 114399 | 92.13% |
| dBBDu186/L098 | 15908 | 114905 | 86.16% |
| dBBDu186/L099 | 2367 | 19583 | 87.91% |
| dBBDu186/L100 | 88856 | 102097 | 12.97% |
| dBBDu186/L101 | 2340 | 37392 | 93.74% |
| dBBDu186/L102 | 2427 | 2685 | 9.61% |
| dBBDu186/L103 | 21977 | 74203 | 70.38% |
| dBBDu186/L104 | 2165 | 2145 | −0.93% |
| dBBDu186/L105 | 13426 | 89231 | 84.95% |
| dBBDu186/L106 | 3088 | 9857 | 68.67% |
| dBBDu186/L107 | 2104 | 2047 | −2.78% |
| dBBDu186/L108 | 50796 | 83558 | 39.21% |

TABLE 12-continued

| | biotin-human CD137-Fc | | |
|---|---|---|---|
| | Free CD3e 62.5 pmol | Free Fc 62.5 pmol | Signal decrease |
| dBBDu189/L109 | 3000 | 76770 | 96.09% |
| dBBDu189/L110 | 3836 | 119618 | 96.79% |
| dBBDu189/L111 | 2568 | 49623 | 94.82% |
| dBBDu189/L112 | 4768 | 91051 | 94.76% |
| dBBDu189/L113 | 3357 | 89648 | 96.26% |
| dBBDu189/L114 | 2158 | 2512 | 14.09% |
| dBBDu189/L115 | 4058 | 141183 | 97.13% |
| dBBDu189/L116 | 3149 | 109316 | 97.12% |
| dBBDu189/L117 | 2625 | 102489 | 97.44% |
| dBBDu189/L118 | 2446 | 19372 | 87.37% |
| dBBDu189/L119 | 20377 | 88058 | 76.86% |
| dBBDu189/L120 | 3778 | 113755 | 96.68% |
| dBBDu189/L121 | 3300 | 37197 | 91.13% |
| dBBDu189/L122 | 3949 | 141349 | 97.21% |
| dBBDu189/L123 | 4950 | 22574 | 78.07% |
| dBBDu189/L124 | 3282 | 111075 | 97.05% |
| dBBDu189/L125 | 6494 | 121498 | 94.66% |
| dBBDu189/L126 | 9750 | 75082 | 87.01% |
| dBBDu193/L127 | 2471 | 6084 | 59.39% |
| dBBDu193/L128 | 3197 | 120777 | 97.35% |
| dBBDu193/L129 | 2773 | 5310 | 47.78% |
| dBBDu193/L130 | 3055 | 124130 | 97.54% |
| dBBDu193/L131 | 15481 | 109233 | 85.83% |
| dBBDu193/L132 | 10414 | 115982 | 91.02% |
| dBBDu193/L133 | 2388 | 33076 | 92.78% |
| dBBDu193/L134 | 3046 | 109154 | 97.21% |
| dBBDu193/L135 | 2284 | 54304 | 95.79% |
| dBBDu193/L136 | 2092 | 113254 | 98.15% |
| dBBDu193/L137 | 2458 | 6602 | 62.77% |
| dBBDu193/L138 | 8165 | 100690 | 91.89% |
| dBBDu193/L139 | 2077 | 2190 | 5.16% |
| dBBDu222/L140 | 2721 | 22972 | 88.16% |
| dBBDu193/L141 | 2166 | 5582 | 61.20% |
| dBBDu193/L142 | 12085 | 103522 | 88.33% |
| dBBDu193/L143 | 2338 | 50082 | 95.33% |
| dBBDu193/L144 | 1952 | 2366 | 17.50% |
| dBBDu193/L145 | 2739 | 2820 | 2.87% |

4.5. Evaluation of Affinity of IgG Having Obtained Fab Domain to CD3 Epsilon, Human CD137 and Cyno CD137

The binding of each IgG obtained in the Reference Example 4.4 to human CD3ed, human CD137 and cyno CD137 was confirmed using Biacore T200. Sixteen antibodies were selected by the results in Reference Example 4.4. Sensor chip CM3 (GE Healthcare) was immobilized with an appropriate amount of sure protein A (GE Healthcare) by amine coupling. The selected antibodies were captured by the chip to allow interaction to human CD3ed, human CD137 and cyno CD137 as an antigen. The running buffer used was 20 mmol/l ACES, 150 mmol/l NaCl, 0.05% (w/v) Tween20, pH 7.4. All measurements were carried out at 25 degrees C. The antigens were diluted using the running buffer.

Regarding human CD137, the selected antibodies were assessed for its binding at antigen concentrations of 4000, 1000, 250, 62.5, and 15.6 nM. Diluted antigen solutions and the running buffer which is the blank were loaded at a flow rate of 30 micro L/min for 180 seconds to allow each concentration of the antigen to interact with the antibody captured on the sensor chip. Then, running buffer was run at a flow rate of 30 micro L/min for 300 seconds and dissociation of the antigen from the antibody was observed. Next, to regenerate the sensor chip, 10 mmol/L glycine-HCl, pH 1.5 was loaded at a flow rate of 30 micro L/min for 10 seconds and 50 mmol/L NaOH was loaded at a flow rate 30 micro L/min for 10 seconds.

Regarding cyno CD137, the selected antibodies were assessed for its binding at antigen concentrations of 4000, 1000 and 250 nM. Diluted antigen solutions and the running buffer which is the blank were loaded at a flow rate of 30 micro L/min for 180 seconds to allow each of the antigens to interact with the antibody captured on the sensor chip. Then, running buffer was run at a flow rate of 30 micro L/min for 300 seconds and dissociation of the antigen from the antibody was observed. Next, to regenerate the sensor chip, 10 mmol/L glycine-HCl. pH 1.5 was loaded at a flow rate of 30 micro L/min for 10 seconds and 50 mmol/L NaOH was loaded at a flow rate 30 micro L/min for 10 seconds.

Regarding human CD3ed, the selected antibodies were assessed for its binding at antigen concentrations of 1000, 250, and 62.5 nM. Diluted antigen solutions and the running buffer which is the blank were loaded at a flow rate of 30 micro L/min for 120 seconds to allow each of the antigens to interact with the antibody captured on the sensor chip. Then, running buffer was run at a flow rate of 30 micro L/min for 180 seconds and dissociation of the antigen from the antibody was observed. Next, to regenerate the sensor chip, 10 mmol/L glycine-HCl. pH 1.5 was loaded at a flow rate of 30 micro L/min for 30 seconds and 50 mmol/L NaOH was loaded at a flow rate 30 micro L/min for 30 seconds.

Kinetic parameters such as the association rate constant ka (1/Ms) and the dissociation rate constant kd (1/s) were calculated based on the sensorgrams obtained by the measurements. The dissociation constant KD (M) was calculated from these constants. Each parameter was calculated using the Biacore T200 Evaluation Software (GE Healthcare). The results are shown in Table 13.

| | | SEQ ID | human CD137 | | |
|---|---|---|---|---|---|
| Hch Name | Lch name | NO | ka (1/Ms) | kd (1/s) | KD (M) |
| dBBDu_183 | dBBDu_L063 | 123 | 2.05E+03 | 3.58E−03 | 1.74E−06 |
| dBBDu 183 | dBBDu_L072 | 124 | 1.76E+03 | 4.25E−03 | 2.41E−06 |
| dBBDu_167 | dBBDu_L091 | 125 | 2.72E+03 | 1.85E−02 | 6.79E−06 |
| dBBDu_186 | dBBDu_L096 | 126 | 2.46E+02 | 5.58E−04 | 2.27E−06 |
| dBBDu_186 | dBBDu_L098 | 127 | 2.31E+02 | 5.34E−04 | 2.31E−06 |
| dBBDu_186 | dBBDu_L106 | 128 | 1.30E+02 | 4.47E−04 | 3.44E−06 |
| dBBDu_189 | dBBDu_L116 | 129 | 7.07E+02 | 2.91E−03 | 4.12E−06 |
| dBBDu_189 | dBBDu_L119 | 130 | 1.48E+02 | 4.02E−04 | 2.71E−06 |
| dBBDu_183 | dBBDu_L067 | 131 | 1.38E+03 | 4.51E−03 | 3.26E−06 |
| dBBDu_186 | dBBDu_L100 | 132 | 3.91E+02 | 7.46E−04 | 1.91E−06 |
| dBBDu_186 | dBBDu_L108 | 133 | 3.35E+02 | 8.10E−04 | 2.41E−06 |
| dBBDu_189 | dBBDu_L112 | 134 | 1.18E+03 | 3.13E−03 | 2.66E−06 |
| dBBDu_189 | dBBDu_L126 | 135 | 1.34E+03 | 6.88E−04 | 5.13E−07 |
| dBBDu_167 | dBBDu.L094 | 136 | 1.21E+03 | 1.02E−02 | 8.43E−06 |
| dBBDu_193 | dBBDu.L127 | 137 | 4.40E+02 | 1.45E−03 | 3.30E−06 |
| dBBDu_193 | dBBDu.L132 | 138 | 4.71E+02 | 2.11E−03 | 4.48E−06 |
| dBBDu_183 | dBBDu_L063 | 123 | 1.47E+03 | 4.57E−03 | 3.12E−06 |
| dBBDu_183 | dBBDu_L072 | 124 | 1.22E+03 | 5.93E−03 | 4.87E−06 |
| dBBDu_167 | dBBDu_L091 | 125 | 2.43E+03 | 1.01E−02 | 4.17E−06 |
| dBBDu_186 | dBBDu_L096 | 126 | 1.09E+01 | 2.23E−03 | 2.05E−04 |
| dBBDu 186 | dBBDu_L098 | 127 | 8.84E+00 | 1.19E−03 | 1.34E−04 |
| dBBDu_186 | dBBDu_L106 | 128 | 2.05E+01 | 1.26E−03 | 6.13E−05 |
| dBBDu_189 | dBBDu_L116 | 129 | 7.44E+02 | 8.23E−03 | 1.11E−05 |
| dBBDu 189 | dBBDu_L119 | 130 | 3.42E+01 | 1.22E−03 | 3.57E−05 |
| dBBDu_183 | dBBDu_L067 | 131 | 1.31E+03 | 8.13E−03 | 6.20E−06 |
| dBBDu_186 | dBBDu_L100 | 132 | 2.95E+01 | 2.08E−03 | 7.04E−05 |
| dBBDu_186 | dBBDu_L108 | 133 | 2.25E+02 | 3.61E−03 | 1.61E−05 |
| dBBDu_189 | dBBDu_L112 | 134 | 4.98E+03 | 2.86E−02 | 5.76E−06 |
| dBBDu 189 | dBBDu_L126 | 135 | 8.07E+02 | 2.47E−03 | 3.06E−06 |
| dBBDu 167 | dBBDu.L094 | 136 | 1.08E+04 | 7.48E−02 | 6.92E−06 |
| dBBDu_193 | dBBDu.L127 | 137 | 1.12E+02 | 3.16E−03 | 2.81E−05 |
| dBBDu_193 | dBBDu.L132 | 138 | 8.06E+00 | 6.10E−03 | 7.57E−04 |
| dBBDu_183 | dBBDu_L063 | 123 | 5.69E+04 | 1.57E−02 | 2.76E−07 |
| dBBDu_183 | dBBDu_L072 | 124 | 3.61E+04 | 7.85E−03 | 2.17E−07 |
| dBBDu_167 | dBBDu_L091 | 125 | 5.24E+04 | 2.16E−02 | 4.13E−07 |
| dBBDu_186 | dBBDu_L096 | 126 | 1.12E+04 | 1.02E−01 | 9.11E−06 |
| dBBDu_186 | dBBDu_L098 | 127 | 1.11E+04 | 2.09E−02 | 1.88E−06 |
| dBBDu_186 | dBBDu_L106 | 128 | 1.03E+04 | 3.18E−02 | 3.09E−06 |
| dBBDu_189 | dBBDu_L116 | 129 | 2.08E+04 | 4.34E−03 | 2.09E−07 |
| dBBDu_189 | dBBDu_L119 | 130 | 1.25E+04 | 2.58E−02 | 2.06E−06 |
| dBBDu_183 | dBBDu_L067 | 131 | 8.89E+04 | 1.93E−02 | 2.17E−07 |
| dBBDu_186 | dBBDu_L100 | 132 | 1.62E+04 | 5.46E−02 | 3.36E−06 |
| dBBDu_186 | dBBDu_L108 | 133 | 1.36E+04 | 4.08E−02 | 3.01E−06 |
| dBBDu_189 | dBBDu_L112 | 134 | 3.03E+04 | 1.00E−02 | 3.31E−07 |
| dBBDu_189 | dBBDu_L126 | 135 | 1.09E+04 | 2.81E−02 | 2.57E−06 |
| dBBDu_167 | dBBDu.L094 | 136 | 6.02E+04 | 2.10E−02 | 3.49E−07 |
| dBBDu_193 | dBBDu.L127 | 137 | 1.26E+04 | 1.91E−02 | 1.51E−06 |
| dBBDu_193 | dBBDu.L132 | 138 | 9.89E+03 | 2.01E−02 | 2.03E−06 |

[Reference Example 5] Preparation of Anti-Human GPC3/Dual-Fab Trispecific Antibodies and Assessment of their Human CD137 Agonist Activities 5.1. Preparation of Anti-Human GPC3/Anti-Human CD137 Bispecific Antibodies and Anti-Human GPC3/Dual-Fab Trispecific Antibodies The anti-human GPC3/anti-human CD137 bispecific antibodies and the anti-human GPC3/Dual-Fab Trispecific antibodies carrying human IgG1 constant regions were produced by the following procedure. Genes encoding an anti-human CD137 antibody (SEQ ID NO: 93 for the H chain, and SEQ ID NO: 94 for the L chain) described in WO2005/035584A1 (abbreviated as B) was used as a control antibody. The anti-human GPC3 side of the antibodies shared the heavy-chain variable region H0000 (SEQ ID NO: 139) and light-chain variable region GL.4 (SEQ ID NO: 140).

Sixteen dual-Ig Fab described in Reference Example 4 and Table 13 was used as candidate dual-Ig antibody. For these molecules, the CrossMab technique reported by Schaefer et al. (Schaefer. Proc. Natl. Acad. Sci., 2011, 108, 11187-11192) was used to regulate the association between the H and L chains and efficiently obtain the bispecific antibodies. More specifically, these molecules were produced by exchanging the VH and VL domains of Fab against human GPC3. For promotion of heterologous association, the Knobs-into-Holes technology was used for the constant region of the antibody H chain. The Knobs-into-Holes technology is a technique that enables preparation of heterodimerized antibodies of interest through promotion of the heterodimerization of H chains by substituting an amino acid side chain present in the CH3 region of one of the H chains with a larger side chain (Knob) and substituting an amino acid side chain in the CH3 region of the other H chain with a smaller side chains (Hole) so that the knob will be placed into the hole (Burmeister, Nature, 1994, 372, 379-383).

Hereinafter, the constant region into which the Knob modification has been introduced will be indicated as Kn, and the constant region into which the Hole modification has been introduced will be indicated as H1. Furthermore, the modifications described in WO2011/108714 were used to reduce the Fc gamma binding Specifically, modifications of substituting Ala for the amino acids at positions 234, 235, and 297 (EU numbering) were introduced. Gly at position 446 and Lys at position 447 (EU numbering) were removed from the C termini of the antibody H chains. A histidine tag was added to the C terminus of the Kn Fe region, and a FLAG tag was added to the C terminus of H1 Fc region. The anti-human GPC3 H chains prepared by introducing the above-mentioned modifications were GC33 (2) H-GidKnHS (SEQ ID NO: 141). The anti-human CD137 H chains prepared were BVH-G1dHIFS (SEQ ID NO: 142). The antibody L chains GC33 (2) L-k0 (SEQ ID NO: 143) and BVL-k0 (SEQ ID NO: 144) were commonly used on the anti-human GPC3 side and the anti-CD137 side, respectively. The H chains and L chains of Dual antibodies are also shown in Table 13. The VH of each dual antibody clones were fused to G1dHIFS (SEQ ID NO: 156) CH region and the VL of each dual antibody clones were fused to k0 (SEQ ID NO: 157) CL region, respectively, as same as BVH-G1dHIFS and BVL-k0. The antibodies having the combinations shown in Table 15 were expressed to obtain the bispecific antibodies of interest. An antibody having received irrelevant was used as control (abbreviated as Ctrl) These antibodies were expressed by transient expression in FreeStyle293 cells (Invitrogen) and purified according to "Reference Example 9".

5.2. Assessment of the In Vitro GPC3-Dependent CD137 Agonist Effect of Anti-Human GPC3/Dual-Fab Trispecific Antibodies The agonistic activity for human CD137 was evaluated on the basis of the cytokine production using ELISA kit (R&D systems. DY206). In order to avoid the effect of CD3 epsilon binding domain of the anti-human GPC3/Dual-Fab antibodies, the B cell strain HDLM-2 was used, which did not express the CD3 epsilon neither GPC3, but express CD137 constitutively. The HDLM-2 was suspended in 20% FBS-containing RPMI-1640 medium at a density of $8\times10^5$ cells/ml. The mouse cancer cell strain CT26-GPC3 which expressed GPC3 (Reference Example 13) was suspended in the same medium at a density of $4\times10^5$ cells/ml. The same volume of each cell suspension was mixed, the mixed cell suspension was seeded into the 96-well plate at a volume of 200 micro I/well. The anti-GPC3/Ctrl antibodies, the anti-GPC3/anti-CD137 antibodies, and eight anti-GPC3/Dual-Fab antibodies prepared in Reference Example 5.1 were added at 30 micro g/ml, 6 micro g/ml, 1.2 micro g/ml, 0.24 micro g/ml each. The cells were cultured under the condition of 37 degrees C., and 5% CO2 for 3 days. The culture supernatant was collected, and the concentration of human IL-6 contained in the supernatant was measured with Human IL-6 DuoSet ELISA (R&D systems, DY206) to assess the HDLM-2 activation. ELISA was performed by following the instructions provided by the kit manufacturer (R&D systems).

As a result (FIG. 18 and Table 14), seven of eight anti-GPC3/Dual-Fab antibodies showed the activation of IL-6 production of HDLM-2 as well as anti-GPC3/anti-CD137 antibodies depending on antibody concentration. In Table 14, agonistic activity compared to Ctrl means the increase level of hIL-6 secretion beyond the background level in the presence of Ctrl. Based on this result, it was thought that these Dual-Fab antibodies have the agonistic activity on human CD137.

TABLE 14

| Antibody | hIL-6 (pg/mL) | | Agonistic activity compared to B | | Agonistic activity compared to Ctrl | |
|---|---|---|---|---|---|---|
| (μg/mL) | 30 | 6 | 30 | 6 | 30 | 6 |
| Ctrl | 906.060814 | 1012.42048 | | | 0.00% | 0.00% |
| B | 4344.80386 | 4524.76696 | 100.00% | 100.00% | 379.53% | 346.93% |
| L063 | 1129.89262 | 967.744207 | 6.51% | −1.27% | 24.70% | −4.41% |
| L072 | 1447.54151 | 1125.01544 | 15.75% | 3.21% | 59.76% | 11.12% |
| L091 | 944.057133 | 934.684418 | 1.10% | −2.21% | 4.19% | −7.68% |
| L096 | 1736.82678 | 1681.25602 | 24.16% | 19.04% | 91.69% | 66.06% |

TABLE 14-continued

| Antibody | hIL-6 (pg/mL) | | Agonistic activity compared to B | | Agonistic activity compared to Ctrl | |
|---|---|---|---|---|---|---|
| (μg/mL) | 30 | 6 | 30 | 6 | 30 | 6 |
| L098 | 1753.61596 | 1501.11166 | 24.65% | 13.91% | 93.54% | 48.27% |
| L106 | 1573.01967 | 1476.44391 | 19.40% | 13.21% | 73.61% | 45.83% |
| L116 | 1566.84383 | 1303.26238 | 19.22% | 8.28% | 72.93% | 28.73% |
| L119 | 1606.92382 | 1255.50299 | 20.38% | 6.92% | 77.35% | 24.01% |

[Reference Example 6] Assessment of the Human CD3 Epsilon Agonist Activities of Anti-Human GPC3/Dual-Fab Trispecific Antibodies

6.1. Preparation of Anti-Human GPC3/Anti-Human CD3 Epsilon Bispecific Antibodies and Anti-Human GPC3/Dual-Fab Trispecific Antibodies The anti-human GPC3/Ctrl bispecific antibodies and the anti-human GPC3/Dual-Fab Trispecific antibodies carrying human IgG1 constant regions were produced in Reference Example 5.1, and the anti-human GPC3/anti-human CD3 epsilon bispecific antibody was also prepared as same construct. CE115 VH (SEQ ID NO: 145) and CE115 VL (SEQ ID NO:146) produced in Reference Example 10 was used for anti-human CD3 epsilon antibody Heavy chain and Light chain. The antibodies having the combinations shown in Table 15. These antibodies were expressed by transient expression in FreeStyle293 cells (Invitrogen) and purified according to "Reference Example 9"

TABLE 15

| Antibody name | Hch gene1 | Lch gene1 | Hch gene1 | Lch gene1 |
|---|---|---|---|---|
| GPC3 ERY22-B | GC33(2)H-G1dKnHS | GC33(2)L-k0 | BVH-G1dHIFS | BVL-k0 |
| GPC3 ERY22-dBBDu_183/L063 | GC33(2)H-G1dKnHS | GC33(2)L-k0 | dBBDu_183VH-G1dHIFS | L063VL-k0 |
| GPC3 ERY22-dBBDu_183/L072 | GC33(2)H-G1dKnHS | GC33(2)L-k0 | dBBDu_183VH-G1dHIFS | L072VL-k0 |
| GPC3 ERY22-dBBDu_167/L091 | GC33(2)H-G1dKnHS | GC33(2)L-k0 | dBBDu_167VH-G1dHIFS | L091VL-k0 |
| GPC3 ERY22-dBBDu_186/L096 | GC33(2)H-G1dKnHS | GC33(2)L-k0 | dBBDu_186VH-G1dHIFS | L096VL-k0 |
| GPC3 ERY22-dBBDu_186/L098 | GC33(2)H-G1dKnHS | GC33(2)L-k0 | dBBDu_186VH-G1dHIFS | L098VL-k0 |
| GPC3 ERY22-dBBDu_186/L106 | GC33(2)H-G1dKnHS | GC33(2)L-k0 | dBBDu_186VH-G1dHIFS | L106VL-k0 |
| GPC3 ERY22-dBBDu_189/L116 | GC33(2)H-G1dKnHS | GC33(2)L-k0 | dBBDu_189VH-G1dHIFS | L116VL-k0 |
| GPC3 ERY22-dBBDu_189/L119 | GC33(2)H-G1dKnHS | GC33(2)L-k0 | dBBDu_189VH-G1dHIFS | L119VL-k0 |
| GPC3 ERY22-dBBDu_183/L067 | GC33(2)H-G1dKnHS | GC33(2)L-k0 | dBBDu_183VH-G1dHIFS | L067VL-k0 |
| GPC3 ERY22-dBBDu_186/L100 | GC33(2)H-G1dKnHS | GC33(2)L-k0 | dBBDu_186VH-G1dHIFS | L100VL-k0 |
| GPC3 ERY22-dBBDu_186/L108 | GC33(2)H-G1dKnHS | GC33(2)L-k0 | dBBDu_186VH-G1dHIFS | L108VL-k0 |
| GPC3 ERY22-dBBDu_189/L112 | GC33(2)H-G1dKnHS | GC33(2)L-k0 | dBBDu_189VH-G1dHIFS | L112VL-k0 |
| GPC3 ERY22-dBBDu_189/L126 | GC33(2)H-G1dKnHS | GC33(2)L-k0 | dBBDu_189VH-G1dHIFS | L126VL-k0 |
| GPC3 ERY22-dBBDu_167/L094 | GC33(2)H-G1dKnHS | GC33(2)L-k0 | dBBDu_167VH-G1dHIFS | L094VL-k0 |
| GPC3 ERY22-dBBDu_193/L127 | GC33(2)H-G1dKnHS | GC33(2)L-k0 | dBBDu_193VH-G1dHIFS | L127VL-k0 |
| GPC3 ERY22-dBBDu_193/L132 | GC33(2)H-G1dKnHS | GC33(2)L-k0 | dBBDu_193VH-G1dHIFS | L132VL-k0 |
| GPC3 ERY22-CE115 | GC33(2)H-G1dKnHS | GC33(2)L-k0 | CE115VH-G1dHIFS | CE115VL-k0 |
| GPC3 ERY22-Ctrl | GC33(2)H-G1dKnHS | GC33(2)L-k0 | CtrlVH-G1dHIFS | CtrlVL-k0 |

6.2. Assessment of the In Vitro GPC3-Dependent CD3 Agonist Effect of Anti-Human GPC3/Dual-Fab Trispecific Antibodies The agonistic activity to human CD3 was evaluated by using GloResponse™ NFAT-luc2 Jurkat Cell Line (Promega. CS #176401) as effector cell. Jurkat cell is an immortalized cell line of human T lymphocyte cells derived from human acute T cell leukemia and it expresses human CD3 on itself. In NFAT luc2_jurkat cell, the expression of Luciferase was induced by the signal from CD3 activation. SK-pca60 cell line which express human GPC3 on the cell membrane (Reference Example 13) was used as target cell.

Both 5.00E+03 SK-pca69 cells (target cells) and 3.00E+04 NFAT-luc2 Jurkat Cells (Effector cells) were added on the each well of white-bottomed, 96-well assay plate (Costar, 3917), and then 10 micro L of each antibodies with 0.1, 1 or 10 mg/L concentration were added on each well and incubated in the presence of 5% CO2 at 37 degrees Celsius for 24 hours. The expressed Luciferase was detected with Bio-Glo luciferase assay system (Promega, G7940) in accordance with the attached instruction, 2104 EnVIsion was used for detection. The result was shown in FIG. 19.

Most Dual Fab clones showed obvious CD3 epsilon agonist activity and some of them showed equal level of activity with CE115 anti-human CD3 epsilon antibody. It demonstrated that addition of CD137 binding activity to Dual-Fab domain did not induce loss of CD3 epsilon agonist activity and that Dual-Fab domain showed not only binding to two different antigen, human CD3 epsilon and CD137 but also the agonist activity of both human CD3 epsilon and CD137 by only one domain.

Some Dual-Fab domain with Heavy chain dBBDu_186 showed weaker CD3 epsilon agonist activity than others. These antibodies also showed weaker affinity to human CD3 epsilon in biacore analysis in Reference Example 4.5. It demonstrates that the CD3 epsilon agonist activity of Dual-Fab from this Dual Fab library only depends on its affinity to human CD3 epsilon, it means the CD3 epsilon agonist activity was retained in this library design.

[Reference Example 7] Assessment of the Human CD3 Epsilon/Human CD137 Synergistic Activities of Dual-Fab Antibodies in PBMC T Cell Cytokine Release Assay

7.1. Antibody Preparation

Anti-CD137 antibodies described in WO2005/035584A1 (abbreviated as B), Ctrl antibodies described in Reference Example 5.1 and anti-CD3 epsilon CE115 antibody, described in Reference Example 7 were used as single antigen specific controls. Dual-Fab. H183L072 (Heavy chain: SEQ ID NO: 104, Light chain: SEQ ID NO: 124) described in Table 13 was selected for further evaluation and was expressed by transient expression in FreeStyle293 cells (Invitrogen) and purified according to "Reference Example 9".

7.2. PBMC T Cell Assay

In order to investigate the synergistic effect of Dual-Fab antibody on CD3 epsilon and CD137 activation, total cytokine release was evaluated using cytometric bead array (CBA) Human Th1/T2 Cytokine kit II (BD Biosciences #551809). Relevant to CD137 activation, IL-2 (Interleukin-2), IFN gamma (Interferon gamma) and TNF alpha (Tumor Necrosis Factor-alpha) were evaluated from T cells were isolated from frozen human peripheral blood mononuclear cells (PBMC) purchased frozen (STEMCELL).

7.2.1. Preparation of Frozen Human PBMC and Isolation of T Cells

Cryovials containing PBMCs were placed in the water bath at 37 degrees C., to thaw cells. Cells were then dispensed into a 15 mL falcon tube containing 9 mL of media (media used to culture target cells). Cell suspension was then subjected to centrifugation at 1.200 rpm for 5 minutes at room temperature. The supernatant was aspirated gently and fresh warmed medium was added for resuspension and used as the human PBMC solution. T cells were isolated using Dynabeads Untouched Human T cell kit (Invitrogen #11344D) following manufacturer's instructions.

7.2.2. Cytokine Release Assay 30 micro g/mL and 10 micro g/mL of antibodies prepared in Reference Example 7.1 were coated on maxisorp 96-well plate (Thermofisher #442404) overnight. 1.00E+05 T cells were added to each well containing antibodies and incubated at 37 degrees C., for 72 hours. Plates were centrifuged at 1,200 rpm for 5 minutes and supernatant was collected. CBA was performed according to manufacturer's instructions and the results are shown in FIG. 20.

Only dual-Fab, H183L072 antibody showed IL-2 secretion by T cells. Neither anti-CD137 (B) not anti-CD3 epsilon antibody (CE115) alone could result in induction of IL-2 from T cells. In addition, anti-CD137 antibody alone did not result in detection of any cytokine. As compared to anti-CD3 epsilon antibody. Dual-Fab antibody resulted in increased levels of TNF alpha and similar secretion of IFN gamma. These results suggest that dual-Fab antibody could elicit synergistic activation of both CD3 epsilon and CD137 for functional activation of T cells.

[Reference Example 8] Assessment of the Cytotoxicity of Anti-GPC3/Dual-Fab Trispecific Antibodies

8.1. Anti-GPC3/Dual-Fab and Anti-GPC3/CD137 Bi-Specific Antibody Preparation Anti-GPC3 or Ctrl antibodies described in Reference Example 6 and Dual-Fab (H183L072) or anti-CD137 antibodies were used to generate four antibodies, Anti-GPC3/dual-Fab, anti-GPC3/CD137. Ctrl/H183L072, and Ctrl/CD137 antibodies using Fab-arm exchange (FAE) according to a method described in (Proc Natl Acad Sci USA. 2013 Mar. 26; 110 (13): 5145-5150). The molecular format of all four antibodies is the same format as a conventional IgG. Anti-GPC3/H183L072 is tri-specific antibody that is able to bind GPC3, CD3, and CD137, anti-GPC3/CD137 is bi-specific antibody that is able to bind GPC3 and CD137, and Ctrl/H183L072, and Ctrl/CD137 were used as control. All four antibodies generated consist of a silent Fc with attenuated affinity for Fc gamma receptor (L.235R,G236R,S239K) and deglycosylated (N297A).

8.2. T-Cell Dependent Cellular Cytotoxicity (TDCC) Assay

Cytotoxic activity was assessed by the rate of cell growth inhibition using xCELLigence Real-Time Cell Analyzer (Roche Diagnostics) as described in Reference Example 10.5.2, 1.00E+04 SK-pca60 or SK-pca13a, both transfectant cell lines expressing GPC3 were used as target (abbreviated as T) cells (Reference Examples 13 and 10 respectively) and co-cultured with 5.00E+04 frozen human PBMCs effector (abbreviated as E) cells that were prepared as described in Reference Example 7.2.1. It means 5-fold amount of effector cells were added on tumor cells, so it is described here as ET 5. Anti-GPC3/H183L072 antibodies and GPC3/CD137 antibodies were added at 0.4, 5 and 10 nM while Ctrl/H183L072 antibodies and Ctrl/CD137 antibodies were added at 10 nM each well. Measurement of cytotoxic activity was conducted similarly as described in Reference Example 10.5.2. The reaction was carried out under the conditions of 5% carbon dioxide gas at 37 degrees C. 72 hours after the addition of PBMCs. Cell Growth Inhibition (CGI) rate (%) was determined using the equation described in Reference Example 10.5.2 and plotted in the graph as shown in FIG. 21. Anti-GPC3/H183L072 dual-Fab antibody which showed CD3 activation on Jurkat cells in Reference Example 6.2 but not Control/H183L072 dual-Fab antibody which did not show CD3 activation and anti-GPC3/CD137 antibody resulted in strong cytotoxic activity of GPC3-expressing cells at all concentrations in both target cell lines, suggesting that Dual-Fab tri-specific antibodies can result in cytotoxic activity.

[Reference Example 9] Preparation of Antibody Expression Vector and Expression and Purification of Antibody Amino acid substitution or IgG conversion was carried out by a method generally known to those skilled in the art using QuikChange Site-Directed Mutagenesis Kit (Stratagene Corp.). PCR, or In fusion Advantage PCR cloning kit (Takara Bio Inc.), etc., to construct expression vectors. The obtained expression vectors were sequenced by a method generally known to those skilled in the art. The prepared plasmids were transiently transferred to human embryonic kidney cancer cell-derived HEK293H line (Invitrogen Corp.) or FreeStyle 293 cells (Invitrogen Corp.) to express antibodies. Each antibody was purified from the obtained culture supernatant by a method generally known to those skilled in the art using rProtein A Sepharose™ Fast Flow (GE Healthcare Japan Corp.). As for the concentration of the purified antibody, the absorbance was measured at 280 nm using a spectrophotometer, and the antibody concentration was calculated by use of an extinction coefficient calculated from the obtained value by PACE (Protein Science 1995; 4: 2411-2423).

[Reference Example 10] Preparation of Anti-Human and Anti-Cynomolgus Monkey CD3 Epsilon Antibody CE115

10.1. Preparation of Hybridoma Using Rat Immunized with Cell Expressing Human CD3 and Cell Expressing Cynomolgus Monkey CD3

Each SD rat (female, 6 weeks old at the start of immunization, Charles River Laboratories Japan, Inc.) was immunized with Ba/F3 cells expressing human CD3 epsilon gamma or cynomolgus monkey CD3 epsilon gamma as follows: at day 0 (the priming date was defined as day 0), $5\times10^7$ Ba/F3 cells expressing human CD3 epsilon gamma were intraperitoneally administered together with a Freund complete adjuvant (Difco Laboratories, Inc.) to the rat. At day 14, $5\times10^7$ Ba/F3 cells expressing cynomolgus monkey CD3 epsilon gamma were intraperitoneally administered thereto together with a Freund incomplete adjuvant (Difco Laboratories, Inc.) Then, $5\times10^7$ Ba/F3 cells expressing human CD3 epsilon gamma and Ba/F3 cells expressing cynomolgus monkey CD3 epsilon gamma were intraperitoneally administered thereto a total of four times every other week in an alternate manner. One week after (at day 49) the final administration of CD3 epsilon gamma. Ba/F3 cells expressing human CD3 epsilon gamma were intravenously administered thereto as a booster. Three days thereafter, the spleen cells of the rat were fused with mouse myeloma cells SP2/0 according to a routine method using PEG1500 (Roche Diagnostics K.K.). Fusion cells, i.e., hybridomas, were cultured in an RPMI1640 medium containing 10% FBS (hereinafter, referred to as 10% FBS/RPMI1640).

On the day after the fusion, (1) the fusion cells were suspended in a semifluid medium (Stemcell Technologies, Inc.). The hybridomas were selectively cultured and also colonized.

Nine or ten days after the fusion, hybridoma colonies were picked up and inoculated at 1 colony/well to a 96-well plate containing a HAT selective medium (10% FBS/RPMI1640, 2 vol % HAT 50× concentrate (Sumitomo Dainippon Pharma Co., Ltd.), and 5 vol % BM-Condimed H1 (Roche Diagnostics K.K.)). After 3- to 4-day culture, the culture supernatant in each well was recovered, and the rat IgG concentration in the culture supernatant was measured. The culture supernatant confirmed to contain rat IgG was screened for a clone producing an antibody specifically binding to human CD3 epsilon gamma by cell-ELISA using attached Ba/F3 cells expressing human CD3 epsilon gamma or attached Ba/F3 cells expressing no human CD3 epsilon gamma (FIG. 22). The clone was also evaluated for cross reactivity with monkey CD3 epsilon gamma by cell-ELISA using attached Ba/F3 cells expressing cynomolgus monkey CD3 epsilon gamma (FIG. 22).

10.2. Preparation of Anti-Human and Anti-Monkey CD3 Epsilon Chimeric Antibody

Total RNA was extracted from each hybridoma cell using RNeasy Mini Kits (Qiagen N.V.), and cDNA was synthesized using SMART RACE cDNA Amplification Kit (BD Biosciences). The prepared cDNA was used in PCR to insert the antibody variable region gene to a cloning vector. The nucleotide sequence of each DNA fragment was determined using BigDye Terminator Cycle Sequencing Kit (Applied Biosystems, Inc.) and a DNA sequencer ABI PRISM 3700 DNA Sequencer (Applied Biosystems, Inc.) according to the method described in the instruction manual included therein. CDRs and FRs of the CE115 H chain variable domain (SEQ ID NO: 162) and the CE115 L chain variable domain (SEQ ID NO: 163) were determined according to the Kabat numbering.

A gene encoding a chimeric antibody H chain containing the rat antibody H chain variable domain linked to a human antibody IgG1 chain constant domain, and a gene encoding a chimeric antibody L chain containing the rat antibody L chain variable domain linked to a human antibody kappa chain constant domain were integrated to expression vectors for animal cells. The prepared expression vectors were used for the expression and purification of the CE115 chimeric antibody (Reference Example 9).

10.3. Preparation of EGFR_ERY22_CE115

Next, IgG against a cancer antigen (EGFR) was used as a backbone to prepare a molecule in a form with one Fab replaced with CD3 epsilon-binding domains. In this operation, silent Fc having attenuated binding activity against FegR (Fc gamma receptor) was used, as in the case mentioned above, as Fc of the backbone IgG. Cetuximab-VH (SEQ ID NO: 164) and Cetuximab-VL (SEQ ID NO: 165) constituting the variable region of cetuximab were used as EGFR-binding domains. G1d derived from IgG1 by the deletion of C-terminal Gly and Lys, A5 derived from G1d by the introduction of D356K and H435R mutations, and B3 derived from G1d by the introduction of a K439E mutation were used as antibody H chain constant domains and each combined with Cetuximab-VH to prepare Cetuximab-VH-G1d (SEQ ID NO: 166), Cetuximab-VH-A5 (SEQ ID NO: 167), and Cetuximab-VH-B3 (SEQ ID NO: 168) according to the method of Reference Example 9. When the antibody H chain constant domain was designated as H1, the sequence corresponding to the antibody H chain having Cetuximab-VH as a variable domain was represented by Cetuximab-VH-H1.

In this context, the alteration of an amino acid is represented by, for example, D356K. The first alphabet (which corresponds to D in D356K) means an alphabet that represents the one-letter code of the amino acid residue before the alteration. The number (which corresponds to 356 in D356K) following the alphabet means the EU numbering position of this altered residue. The last alphabet (which corresponds to K in D356K) means an alphabet that represents the one-letter code of an amino acid residue after the alteration.

EGFR_ERY22_CE115 (FIG. 23) was prepared by the exchange between the VH domain and the VL domain of Fab against EGFR. Specifically, a series of expression vectors having an insert of each polynucleotide encoding EGFR ERY22_Hk (SEQ ID NO: 169), EGFR ERY22_L (SEQ ID NO: 170), CE115_ERY22_Hh (SEQ ID NO: 171), or CE115_ERY22_L (SEQ ID NO: 172) was prepared by a method generally known to those skilled in the art, such as PCR, using primers with an appropriate sequence added in the same way as the aforementioned method.

The expression vectors were transferred in the following combination to FreeStyle 293-F cells where each molecule of interest was transiently expressed.

Molecule of Interest: EGFR_ERY22_CE115

Polypeptides encoded by the polynucleotides inserted in the expression vectors: EGFR ERY22_Hk, EGFR ERY22_L, CE115_ERY22_Hh, and CE115_ERY22_L 10.4. Purification of EGFR_ERY22_CE115

The obtained culture supernatant was added to Anti FLAG M2 column (Sigma-Aldrich Corp.), and the column was washed, followed by elution with 0.1 mg/mL FLAG peptide (Sigma-Aldrich Corp.). The fraction containing the molecule of interest was added to HisTrap HP column (GE Healthcare Japan Corp.), and the column was washed, followed by elution with the concentration gradient of imidazole. The fraction containing the molecule of interest was concentrated by ultrafiltration. Then, this fraction was added to Superdex 200 column (GE Healthcare Japan Corp.). Only a monomer fraction was recovered from the eluate to obtain each purified molecule of interest.

10.5. Measurement of Cytotoxic Activity Using Human Peripheral Blood Mononuclear Cell 10.5.1. Preparation of Human Peripheral Blood Mononuclear Cell (PBMC) Solution 50 mL of peripheral blood was collected from each healthy volunteer (adult) using a syringe pre-filled with 100 micro L of 1,000 units/mL of a heparin solution (Novo-Heparin 5,000 units for Injection. Novo Nordisk A/S). The peripheral blood was diluted 2-fold with PBS(−) and then divided into four equal parts, which were then added to Leucosep lymphocyte separation tubes (Cat. No. 227290. Greiner Bio-One GmbH) pre-filled with 15 mL of Ficoll-Paque PLUS and centrifuged in advance. After centrifugation (2.150 rpm, 10 minutes, room temperature) of the separation tubes, a mononuclear cell fraction layer was separated. The cells in the mononuclear cell fraction were washed once with Dulbecco's Modified Eagle's Medium containing 10% FBS (Sigma-Aldrich Corp.; hereinafter, referred to as 10% FBS/D-MEM). Then, the cells were adjusted to a cell density of $4\times10^6$ cells/mL with 10% FBS/D-MEM. The cell solution thus prepared was used as a human PBMC solution in the subsequent test.

10.5.2. Measurement of Cytotoxic Activity

The cytotoxic activity was evaluated on the basis of the rate of cell growth inhibition using xCELLigence real-time cell analyzer (Roche Diagnostics). The target cells used were an SK-pca13a cell line established by forcing an SK-HEP-1 cell line to express human EGFR. SK-pca13a was dissociated from the dish and inoculated at 100 micro L/well ($1\times10^4$ cells/well) to an E-Plate 96 plate (Roche Diagnostics) to start the assay of live cells using the xCELLigence real-time cell analyzer. On the next day, the plate was taken out of the xCELLigence real-time cell analyzer, and 50 micro L of each antibody adjusted to each concentration (0.004, 0.04, 0.4, and 4 nM) was added to the plate. After reaction at room temperature for 15 minutes, 50 micro L ($2\times10^5$ cells/well) of the human PBMC solution prepared in the preceding paragraph 10.5.1 was added thereto. This plate was reloaded to the xCELLigence real-time cell analyzer to start the assay of live cells. The reaction was carried out under conditions of 5% CO2 and 37 degrees C. 72 hours after the addition of human PBMC. The rate of cell growth inhibition (%) was determined from the cell index value according to the expression given below. A numeric value after normalization against the cell index value immediately before the addition of the antibody defined as 1 was used as the cell index value in this calculation.

Rate of cell growth inhibition (%)=(A−B)×100/(A−1), wherein

A represents the average cell index value of wells non-supplemented with the antibody (only the target cells and human PBMC), and B represents the average cell index value of the wells supplemented with each antibody. The test was conducted in triplicate.

The cytotoxic activity of EGFR_ERY22_CE115 containing CE115 was measured with PBMC prepared from human blood as effector cells. As a result, very strong activity was confirmed (FIG. 24).

[Reference Example 11] Antibody Alteration for Preparation of Antibody Binding to CD3 and Second Antigen 11.1. Study on Insertion Site and Length of Peptide Capable of Binding to Second Antigen A study was conducted to obtain a dual binding Fab molecule capable of binding to a cancer antigen through one variable region (Fab) and binding to the first antigen CD3 and the second antigen through the other variable region, but not capable of binding to CD3 and the second antigen at the same time. A GGS peptide was inserted to the heavy chain loop of the CD3 epsilon-binding antibody CE115 to prepare each heterodimerized antibody having EGFR-binding domains in one Fab and CD3-binding domains in the other Fab according to Reference Example 9.

Specifically, EGFR_ERY22_Hk/EGFR_ERY22_L/CE115_CE31 ERY22_Hh/CE115_ERY22_L ((SEQ ID NO: 169/170/173/172) with GGS inserted between K52B and S52c in CDR2, EGFR_ERY22_HW/EGFR_ERY22_L/CE115_CE32 ERY22_Hh/CE115_ERY22_L ((SEQ ID NO: 169/170/174/172) with a GGSGGS peptide (SEQ ID NO: 175) inserted at this position, and EGFR_ERY22_Hk/EGFR ERY22_L/CE115_CE33 ERY22_Hh/CE115_ERY22_L ((SEQ ID NO: 169/170/176/172) with a GGSGGSGGS peptide (SEQ ID NO: 177) inserted at this position were prepared. Likewise, EGFR_ERY22_HW/EGFR_ERY22_L/CE115_CE34 ERY22_Hh/CE115_ERY22_L ((SEQ ID NO: 169/170/178/172) with GGS inserted between D72 and D73 (loop) in FR3, EGFR_ERY22_Hk/EGFR ERY22_L/CE115_CE35 ERY22_Hh/CE115_ERY22_L ((SEQ ID NO: 169/170/179/172) with a GGSGGS peptide (SEQ ID NO: 175) inserted at this position, and EGFR_ERY22_Hk/EGFR_ERY22_L/CE115_CE36 ERY22_Hh/CE115_ERY22_L ((SEQ ID NO: 169/170/180/172) with a GGSGGSGGS peptide (SEQ ID NO: 177) inserted at this position were prepared. In addition, EGFR_ERY22_Hk/EGFR ERY22_L/CE115_CE37 ERY22_Hh/CE115_ERY22_L ((SEQ ID NO. 169/170/181/172) with GGS inserted between A99 and Y100 in CDR3. EGFR ERY22_Hk/EGFR_ERY22_L/CE115_CE38 ERY22_Hh/CE115_ERY22_L ((SEQ ID NO: 169/170/182/172) with a GGSGGS peptide inserted at this position, and EGFR ERY22_HW/EGFR_ERY22_L/CE115_CE39 ERY22_Hh/CE115_ERY22_L ((SEQ ID NO: 169/170/183/172) with a GGSGGSGGS peptide inserted at this position were prepared.

11.2. Confirmation of Binding of GGS Peptide-Inserted CE115 Antibody to CD3 Epsilon The binding activity of each prepared antibody against CD3 epsilon was confirmed using Biacore T100. A biotinylated CD3 epsilon epitope peptide was immobilized to a CM5 chip via streptavidin, and the prepared antibody was injected thereto as an analyte and analyzed for its binding affinity.

The results are shown in Table 16. The binding affinity of CE35, CE36, CE37, CE38, and CE39 for CD3 epsilon was equivalent to the parent antibody CE115. This indicated that a peptide binding to the second antigen can be inserted into their loops. The binding affinity was not reduced in GGSGGSGGS-inserted CE36 or CE39. This indicated that the insertion of a peptide up to at least 9 amino acids to these sites does not influence the binding activity against CD3 epsilon.

TABLE 16

| Sample<br>CE115_M | ka<br>1.5E+05 | kd<br>9.8E−03 | KD<br>6.7E−08 | Insertion<br>position | Linker |
|---|---|---|---|---|---|
| CE31 | 2.3E+05 | 3.5E−02 | 1.5E−07 | K52b-S52c | GS3 |
| CE32 | 8.5E+04 | 1.8E−02 | 2.1E−07 | K52b-S52c | GS6 |
| CE33 | 4.9E+05 | 1.1E−01 | 2.3E−07 | K52b-S52c | GS9 |
| CE34 | 1.1E+05 | 1.3E−02 | 1.2E−07 | D72-D73 | GS3 |
| CE35 | 1.3E+05 | 1.1E−02 | 8.7E−08 | D72-D73 | GS6 |
| CE36 | 1.2E+05 | 1.2E−02 | 9.9E−08 | D72-D73 | GS9 |
| CE37 | 2.2E+05 | 2.0E−02 | 9.4E−08 | A99-Y100 | GS3 |
| CE38 | 2.0E+05 | 1.7E−02 | 8.7E−08 | A99-Y100 | GS6 |
| CE39 | 1.6E+05 | 1.4E−02 | 9.1E−08 | A99-Y100 | GS9 |

These results indicated that the antibody capable of binding to CD3 and the second antigen, but does not bind to these antigens at the same time can be prepared by obtaining an antibody binding to the second antigen using such peptide-inserted CE115 In this context, a library can be prepared by altering at random the amino acid sequence of the peptide for use in insertion or substitution according to a method known in the art such as site-directed mutagenesis (Kunkel et al., Proc. Natl. Acad. Sci. U.S.A. (1985) 82, 488-492) or overlap extension PCR, and comparing the binding activity, etc., of each altered form according to the aforementioned method to determine an insertion or substitution site that permits exertion of the activity of interest even after alteration of the amino acid sequence, and the types and length of amino acids of this site.

[Reference Example 12] Library Design for Obtaining Antibody Binding to CD3 and Second Antigen

12.1. Antibody Library for Obtaining Antibody Binding to CD3 and Second Antigen (Also Referred to as Dual Fab Library)

In the case of selecting CD3 (CD3 epsilon) as the first antigen, examples of a method for obtaining an antibody binding to CD3 (CD3 epsilon) and an arbitrary second antigen include the following 6 methods:

1. a method which involves inserting a peptide or a polypeptide binding to the second antigen to a Fab domain binding to the first antigen (this method includes the peptide insertion shown in Example 3 or 4 in WO2016076345A1 (or, as well as a G-CSF insertion method illustrated in Angew Chem Int Ed Engl. 2013 Aug. 5:52 (32): 8295-8), wherein the binding peptide or polypeptide may be obtained from a peptide-or poly peptide-displaying library, or the whole or a portion of a naturally occurring protein may be used;
2, a method which involves preparing an antibody library such that various amino acids appear positions that permit alteration to a larger length (extension) of Fab loops as shown in Example 5 in WO2016076345A1, and obtaining Fab having binding activity against an arbitrary second antigen from the antibody library by using the binding activity against the antigen as an index;
3, a method which involves identifying amino acids that maintain binding activity against CD3 by use of an antibody prepared by site-directed mutagenesis from a Fab domain previously known to bind to CD3, and obtaining Fab having binding activity against an arbitrary second antigen from an antibody library in which the identified amino acids appear by using the binding activity against the antigen as an index;
4, the method 3 which further involves preparing an antibody library such that various amino acids appear positions that permit alteration to a larger length (extension) of Fab loops, and obtaining Fab having binding activity against an arbitrary second antigen from the antibody library by using the binding activity against the antigen as an index;
5, the method 1, 2, 3, or 4 which further involves altering the antibodies such that glycosylation sequences (e.g., NxS and NXT wherein x is an amino acid other than P) appear to add thereto sugar chains that are recognized by sugar chain receptors (e.g., high-mannose-type sugar chains are added thereto and thereby recognized by high-mannose receptors: it is known that the high-mannose-type sugar chains are obtained by the addition of kifunensine at the time of antibody expression (mAbs. 2012 July-August; 4 (4): 475-87)); and
6, the method 1, 2. 3, or 4 which further involves adding thereto domains (polypeptides, sugar chains, and nucleic acids typified by TLR agonists) each binding to the second antigen through a covalent bond by inserting Cys, Lys, or a non-natural amino acid to loops or sites found to be alterable to various amino acids or substituting these sites with Cys, Lys, or a non-natural amino acid (this method is typified by antibody drug conjugates and is a method for conjugation to Cys. Lys, or a non-natural amino acid through a covalent bond (described in mAbs 6:1, 34-45; January/February 2014; WO2009/134891 A2; and Bioconjug Chem. 2014 Feb. 19, 25 (2): 351-61)).

The dual binding Fab that binds to the first antigen and the second antigen, but does not bind to these antigens at the same time is obtained by use of any of these methods, and can be combined with domains binding to an arbitrary third antigen by a method generally known to those skilled in the art, for example, common L chains, CrossMab, or Fab arm exchange.

12.2. Preparation of One-Amino Acid Alteration Antibody of CD3 (CD3 Epsilon)-Binding Antibody Using Site-Directed Mutagenesis A VH domain CE115HA000 (SEQ ID NO: 184) and a VL domain GLS3000 (SEQ ID NO: 185) were selected as template sequences for a CD3 (CD3 epsilon)-binding antibody. Each domain was subjected to amino acid alteration at a site presumed to participate in antigen binding according to Reference Example 9. Also, pE22Hh (sequence derived from natural IgG1 CH1 and subsequent sequences by the alteration of L234A, L235A, N297A, D356C, T366S, L368A, and Y407V, the deletion of a C-terminal GK sequence, and the addition of a DYKDDDDK sequence (SEQ ID NO: 200); SEQ ID NO: 186) was used as an H chain constant domain, and a kappa chain (SEQ ID NO: 187) was used as an L chain constant domain. The alteration sites are shown in Table 17. For CD3 (CD3 epsilon)-binding activity evaluation, each one-amino acid alteration antibody was obtained as a one-arm antibody (naturally occurring IgG antibody lacking one of the Fab domains). Specifically, in the case of H chain alteration, the altered H chain linked to the constant domain pE22Hh, and Kn010G3 (naturally occurring IgG1 amino acid sequence from position 216 to the C terminus having C220S, Y349C, T366W, and H435R alterations; SEQ ID NO: 188) were used as H chains, and GLS3000 linked at the 3' side to the kappa chain was used as an L chain. In the case of L chain alteration, the altered L chain linked at the 3' side to the kappa chain was used as an L chain, and CE115HA000 linked at the 3' side to pE22Hh, and Kn010G3 were used as H chains. These sequences were expressed and purified in FreeStyle 293 cells (which employed the method of Reference Example 9).

H chain alteration site

| Domain | FR1 | | | | | | CDR1 | | | | FR2 |
|---|---|---|---|---|---|---|---|---|---|---|---|
| Kabat numbering | 11 | 16 | 19 | 28 | 29 | 30 | 31 | 32 | 33 | 35 | 43 |
| Amino acid before substitution | V | R | R | T | F | S | N | A | W | H | K |

| Domain | CDR2 | | | | | | | | | | | | | | | | | |
|---|---|---|---|---|---|---|---|---|---|---|---|---|---|---|---|---|---|---|
| Kabat numbering | 50 | 51 | 52 | 52a | 52b | 52c | 53 | 54 | 55 | 56 | 57 | 58 | 59 | 60 | 61 | 62 | 64 | 65 |
| Amino acid before substitution | Q | I | K | A | K | S | N | N | Y | A | T | Y | Y | A | E | S | K | G |

| Domain | FR3 | | | | | | | | CDR3 | | | | | | | | | | | FR4 |
|---|---|---|---|---|---|---|---|---|---|---|---|---|---|---|---|---|---|---|---|---|
| Kabat numbering | 72 | 73 | 74 | 75 | 76 | 77 | 78 | 82a | 95 | 96 | 97 | 98 | 99 | 100 | 100a | 100b | 100c | 101 | 102 | 105 |
| Amino acid before substitution | D | D | S | K | N | S | L | N | V | H | Y | G | A | Y | Y | G | V | D | A | Q |

L chain alteration site

| Domain | CDR1 | | | | | | | | | | | | | | | | FR2 |
|---|---|---|---|---|---|---|---|---|---|---|---|---|---|---|---|---|---|
| Kabat numbering | 24 | 25 | 26 | 27 | 27a | 27b | 27c | 27d | 27e | 28 | 29 | 30 | 31 | 32 | 33 | 34 | 45 |
| Amino acid before substitution | R | S | S | Q | S | L | V | H | S | N | R | N | 1 | Y | L | H | Q |

| Domain | CDR2 | | | | | | | FR3 | | CDR3 | | | | | | | | | FR4 |
|---|---|---|---|---|---|---|---|---|---|---|---|---|---|---|---|---|---|---|---|
| Kabat numbering | 50 | 51 | 52 | 53 | 54 | 55 | 56 | 74 | 77 | 89 | 90 | 91 | 92 | 93 | 94 | 95 | 96 | 97 | 107 |
| Amino acid before substitution | K | V | S | N | R | F | S | K | R | G | Q | G | T | Q | V | P | Y | T | K |

12.3. Evaluation of Binding of One-Amino Acid Alteration Antibody to CD3

Each one-amino acid altered form constructed, expressed, and purified in the paragraph 12.2. was evaluated using Biacore T200 (GE Healthcare Japan Corp.). An appropriate amount of CD3 epsilon homodimer protein was immobilized onto Sensor chip CM4 (GE Healthcare Japan Corp.) by the amine coupling method. Then, the antibody having an appropriate concentration was injected thereto as an analyte and allowed to interact with the CD3 epsilon homodimer protein on the sensor chip. Then, the sensor chip was regenerated by the injection of 10 mmol/L glycine-HCl (pH 1.5). The assay was conducted at 25 degrees C., and HBS-EP+ (GE Healthcare Japan Corp.) was used as a running buffer. From the assay results, the dissociation constant Kn (M) was calculated using single-cycle kinetics model (1:1 binding R1=0) for the amount bound and the sensorgram obtained in the assay. Each parameter was calculated using Biacore T200 Evaluation Software (GE Healthcare Japan Corp.).

12.3.1. Alteration of H Chain

Table 18 shows the results of the ratio of the amount of each H chain altered form bound to the amount of the corresponding unaltered antibody CE115HA000 bound. Specifically, when the amount of the antibody comprising CE115HA000 bound was defined as X and the amount of the H chain one-amino acid altered form bound was defined as Y, a value of Z (ratio of amounts bound)=Y/X was used. As shown in FIG. 25, a very small amount bound was observed in the sensorgram for Z of less than 0.8, suggesting the possibility that the dissociation constant $K_D$ (M) cannot be calculated correctly. Table 19 shows the dissociation constant $K_D$ (M) ratio of each H chain altered form to CE115HA000 (=$K_D$ value of CE115HA000/$K_D$ value of the altered form). When Z shown in Table 18 is 0.8 or more, the altered form is considered to maintain the binding relative to the corresponding unaltered antibody CE115HA000. Therefore, an antibody library designed such that these amino acids appear can serve as a dual Fab library.

| Domain | FR1 | | | | | | CDR1 | | | | FR2 | CDR2 | | | | |
|---|---|---|---|---|---|---|---|---|---|---|---|---|---|---|---|---|
| Kabat numbering | 11 | 16 | 19 | 28 | 29 | 30 | 31 | 32 | 33 | 35 | 43 | 50 | 51 | 52 | 52a | 52b |
| Amino acid before substitution (wt) | V | R | R | T | F | S | N | A | W | H | K | Q | I | K | A | K |
| A | | | | | | | 0.5 | | 0.1 | 0.17 | | 0.24 | | | | 0.67 |
| D | | | | 0.56 | | 0.86 | 0.37 | | 0.1 | 0.2 | | 0.27 | 0.29 | 0.25 | 1.34 | 0.27 |
| E | | 0.88 | | | | | | | | 0.19 | 0.9 | 0.26 | 0.55 | 0.26 | 0.57 | |
| F | | | | | | | 0.62 | | 0.65 | 0.21 | | | | 0.17 | | |
| G | | | | | | 1.01 | 0.39 | | | 0.22 | | | | | 0.81 | |
| H | | | | | | | 0.68 | | 0.13 | | | | | 0.22 | | |
| I | | | | | | | 0.81 | | | 0.12 | | 0.4 | | 0.33 | | |
| K | | | | | | | 1.01 | | | 0.15 | | 0.33 | | | | |
| L | 1 | | | | | | | | 0.1 | 0.11 | | 0.23 | | | | 0.61 |
| M | | | | | | | | | | 0.29 | | | | | | |
| N | | | | | | | | | | 0.35 | | 0.17 | | 0.34 | | 0.27 |
| P | | | | | | | | | | | | | | | 0.15 | |
| Q | | 0.9 | | | | | 0.49 | | | 0.13 | 0.99 | | | | | 0.6 |
| R | | | | | | | 1.14 | | | 0.14 | | | | 0.91 | | 1.11 |
| S | | | | 0.91 | | | 0.81 | | | 0.23 | | 0.24 | | 0.28 | 1.05 | 0.68 |
| T | | | 0.8 | | | | | | | 0.26 | | | | | | |
| Y | | | | | 0.36 | | | | | 0.22 | | | | | 0.52 | |
| W | | | | | | | 0.63 | | | 0.22 | | | | 0.22 | | |
| Y | | | | | | | 0.64 | 0.33 | 0.66 | 0.16 | | 0.25 | | 0.18 | 0.31 | 0.74 |

| Domain | CDR2 | | | | | | | | | | | | | FR3 | | |
|---|---|---|---|---|---|---|---|---|---|---|---|---|---|---|---|---|
| Kabat numbering | 52c | 53 | 54 | 55 | 56 | 57 | 58 | 59 | 60 | 61 | 62 | 64 | 65 | 72 | 73 | 74 |
| Amino acid before substitution (wt) | S | N | N | Y | A | T | Y | Y | A | E | S | K | G | D | D | S |
| A | 0.96 | 0.7 | 0.85 | | | 0.98 | 0.22 | 0.85 | | 1.09 | | 0.82 | | 1.41 | 0.83 | 1.05 |
| D | 0.6 | 0.39 | 0.62 | 0.45 | 0.51 | | 0.11 | 0.7 | 0.99 | 0.91 | 0.92 | 0.72 | 0.76 | | | |
| E | | | | | | | | 0.66 | 0.94 | | 0.92 | 0.74 | 0.78 | 1.05 | 0.73 | |
| F | 1.13 | | 1.12 | | | | | | | | | | | | | |
| G | 0.97 | 0.5 | 0.98 | 0.65 | 0.61 | | | | | | | | | | 1.07 | |
| H | | 0.76 | | | | | | | | | | | | | | |
| I | | 0.68 | | | | 0.61 | | | | | | | | | | |
| K | 1.19 | 0.78 | 1.2 | | 1.35 | 1.32 | 0.3 | | | | 1.19 | | | | 0.87 | |
| L | 0.98 | | 0.94 | | 0.8 | | 0.27 | | | | | | | | | |
| M | | | | | | | | | | | | | | | | |
| N | | | | | 0.87 | 0.97 | 0.33 | | | | | | | | 0.94 | |
| P | | | | | | | | | | 1.07 | 1 | | | | | 0.91 |
| Q | 1.04 | 1.1 | 0.84 | | 0.76 | | 0.19 | | | 1.07 | | 0.89 | | | | |
| R | | | | | | | | | | | | | | | 1.04 | |

-continued

| | | | | | | | | | | | | | | | | | |
|---|---|---|---|---|---|---|---|---|---|---|---|---|---|---|---|---|---|
| S | | 0.83 | 0.84 | 0.28 | | | 0.18 | 0.94 | | | | 0.84 | | | | | |
| T | | | | | | | | | | | | | | | 0.63 | | |
| Y | 0.93 | | | | | | | | | | | | | 1.43 | | | |
| W | | 0.88 | | | | | | | | | | | | | | | |
| Y | 1.11 | 0.63 | 1.09 | | 0.66 | | | | | | | | | | | | |
| Domain | FR3 | | | | | CDR3 | | | | | | | | | | | FR4 |
| Kabat numbering | 75 | 78 | 77 | 78 | 82a | 95 | 96 | 97 | 98 | 99 | 100 | 100a | 100b | 100c | 101 | 102 | 105 |
| Amino acid before substitution (wt) | K | N | S | L | N | V | H | Y | G | A | Y | Y | G | V | D | A | Q |
| A | | | | | | 0.11 | 0.35 | 0.16 | 1.1 | | 0.9 | 0.62 | | | 1.26 | | |
| D | | | | | 0.73 | 0.24 | 0.09 | 0.24 | 0.26 | 0.28 | 0.52 | 0.31 | 0.27 | 0.44 | | | |
| E | | | | | | 0.24 | | | | | | | 0.26 | 0.46 | | | 0.94 |
| F | | | | | | | | | | 1.43 | | 0.87 | 0.3 | | 0.75 | | |
| G | | | | | | 0.19 | 0.43 | 0.18 | | | 1.07 | 1.23 | | | 1.38 | | |
| H | | | | | | | | | 1.58 | | | | | | 1.21 | | |
| I | | | | 1.34 | | | | | | | | | | | 1.18 | 1.48 | |
| K | | | | | | 0.64 | 0.35 | | 2.83 | 1.48 | 1.07 | 0.9 | | | 0.63 | | |
| L | | | | | | | 0.14 | | | 1.13 | 0.7 | 0.48 | 0.27 | | 0.62 | | |
| M | | | | | | | | | | | | | | | 1.2 | | |
| N | | | | | | | | | | | | | | | 2.02 | | |
| P | | | | | | | 0.12 | 0.11 | 1.02 | | 0.48 | | | 0.2 | 0.2 | 0.14 | |
| Q | | | | | | | 0.42 | | 1.22 | 0.91 | 0.8 | 0.56 | | | 2.35 | | |
| R | 1.01 | | | | | | 0.46 | 0.27 | 2.96 | | | | | | 0.24 | | |
| S | | 0.92 | | | | 0.22 | 0.44 | 0.18 | 1.01 | 0.82 | 0.81 | 0.64 | 0.52 | | 1.16 | | |
| T | 0.84 | | 0.9 | | | | | | 1.05 | 0.84 | | | | | 0.79 | | |
| V | | | | | | | | | | | 0.6 | | | | 1.33 | 1.43 | |
| W | | | | | | | | | | | 1.03 | | | | | | |
| Y | | | | | | | 0.17 | | 2.22 | 1.59 | | | 0.23 | | 0.49 | 0.91 | |

TABLE 19

| Domain | FR1 | | | | | | CDR1 | | | | FR2 | CDR2 | | |
|---|---|---|---|---|---|---|---|---|---|---|---|---|---|---|
| Kabat numbering | 11 | 16 | 19 | 28 | 29 | 30 | 31 | 32 | 33 | 35 | 43 | 50 | 51 | 52 |
| Amino acid before substitution (wt) | V | R | R | T | F | S | N | A | W | H | K | Q | I | K |
| A | | | | | | | 0.96 | | 29.99 | 25.04 | | 22.63 | | |
| D | | | | 0.93 | | 0.79 | 1.14 | | 1693.03 | 68.99 | | 75.37 | 6.37 | 166.47 |
| E | | 0.74 | | | | | | | | 70.35 | 0.88 | 16738.09 | 0.84 | 19.38 |
| F | | | | | | | 1.24 | | 0.66 | 53.59 | | | | 4.04 |
| G | | | | | | 0.93 | 1.37 | | | 45.77 | | | | |
| H | | | | | | | 0.96 | | 4.96 | | | | | 2.65 |
| I | | | | | | | 0.62 | | | 7.23 | | 1.21 | | 3.54 |
| K | | | | | | | 0.97 | | | 14.45 | | 0.71 | | |
| L | 0.83 | | | | | | | | 56573.23 | 4.8 | | 1.41 | | |
| M | | | | | | | | | | 3.98 | | | | |
| N | | | | | | | | | | 2.88 | | 1.48 | | 3.29 |
| P | | | | | | | | | | | | | | |
| Q | | 0.87 | | | | | 0.94 | | | 4.8 | 0.89 | | | |
| R | | | | | | | 0.98 | | | 15429.77 | | | | 0.8 |
| S | | | | 0.79 | | | 0.67 | | | 2.93 | | 47.38 | | 92.1 |
| T | | | 0.81 | | | | | | | 4.4 | | | | |
| V | | | | | 2.94 | | | | | 28.08 | | | | |
| W | | | | | | | 1.07 | | | 50.42 | | | | 2.69 |
| Y | | | | | | | 1.1 | 2.11 | 0.69 | 119458.13 | | 49.09 | | 6.47 |

| Domain | CDR2 | | | | | | | | | | | | | | |
|---|---|---|---|---|---|---|---|---|---|---|---|---|---|---|---|
| Kabat numbering | 52a | 52b | 52c | 53 | 54 | 55 | 56 | 57 | 58 | 59 | 60 | 61 | 62 | 64 | 65 |
| Amino acid before substitution (wt) | A | K | S | N | N | Y | A | T | Y | Y | A | E | S | K | G |
| A | | 0.58 | 0.67 | 0.55 | 0.58 | | | 0.87 | 1.06 | 0.74 | | 0.94 | | 0.81 | |
| D | 1.35 | 0.56 | 0.55 | 0.55 | 0.59 | 0.89 | 0.71 | | 4.81 | 0.66 | 0.94 | 0.9 | 0.87 | 0.76 | 0.61 |
| E | 0.89 | | | | | | | | | 0.61 | 0.88 | | 0.82 | 0.84 | 0.61 |
| F | | | 0.93 | | 0.97 | | | | | | | | | | |
| G | 0.61 | | 0.81 | 0.95 | 0.84 | 0.99 | 0.59 | | | | | | | | |
| H | | | | 0.55 | | | | | | | | | | | |
| I | | | | 0.57 | | | | 0.81 | | | | | | | |

TABLE 19-continued

| | | | | | | | | | | | | | |
|---|---|---|---|---|---|---|---|---|---|---|---|---|---|
| K | | | 0.88 | 0.79 | 0.82 | | 1.32 | 1.22 | 0.66 | | | 0.99 | |
| L | | 0.61 | 0.94 | | 0.91 | | 0.77 | | 1.21 | | | | |
| M | | | | | | | | | | | | | |
| N | | 0.43 | | | | | 0.84 | 0.9 | 1.66 | | | | |
| P | 5 | | | | | | | | | | 0.82 | 0.77 | |
| Q | | 0.62 | 0.97 | 1.05 | 0.8 | | 0.74 | | 1.24 | | 0.85 | | 0.87 |
| R | | 0.91 | | | | | | | | | | | |
| S | 0.82 | 0.58 | | 0.59 | 0.57 | 5.65 | | | 1.22 | 0.79 | | | 0.85 |
| T | | | | | | | | | | | | | |
| V | 0.85 | | 0.82 | | | | | | | | | | |
| W | | | | 0.69 | | | | | | | | | |
| Y | 7.71 | 0.61 | 0.87 | 0.94 | 1.03 | | 0.63 | | | | | | |

| Domain | FR3 | | | | | | | | CDR3 | | | | |
|---|---|---|---|---|---|---|---|---|---|---|---|---|---|
| Kabat numbering | 72 | 73 | 74 | 75 | 76 | 77 | 78 | 82a | 95 | 96 | 97 | 98 | 99 |
| Amino acid before substitution (wt) | D | D | S | K | N | S | L | N | V | H | Y | G | A |
| A | 1.19 | 0.73 | 0.77 | | | | | | 3.15 | 1 | 41309 | 0.98 | |
| D | | | | | | | | 0.56 | 108.01 | 7.27 | 64.7 | 2.36 | 1.03 |
| E | 0.73 | 0.56 | | | | | | | 50.46 | | | | |
| F | | | | | | | | | | | | | 1.15 |
| G | | 0.78 | | | | | | | 78256.33 | 0.8 | 47213 | | |
| H | | | | | | | | | | | | 1.14 | |
| I | | | | | | | 1.08 | | | | | | |
| K | | 0.74 | | | | | | | 1.15 | 1.56 | | 4.85 | 1.4 |
| L | | | | | | | | | | 3.14 | | | 1 |
| M | | | | | | | | | | | | | |
| N | | 0.7 | | | | | | | | | | | |
| P | | | 0.7 | | | | | | | 87044.4 | 12429 | 0.88 | |
| Q | | | | | | | | | | 1.36 | | 1.04 | 0.85 |
| R | | 0.79 | | 0.88 | | | | | | 1.59 | 23180 | 4.69 | |
| S | | | | | 0.84 | | | | 4.61 | 1.15 | 1178 | 0.98 | 0.76 |
| T | | 0.78 | | 0.75 | | 0.83 | | | | | | 0.93 | 0.93 |
| V | 1.17 | | | | | | | | | | | | |
| W | | | | | | | | | | | | | |
| Y | | | | | | | | | | 6.67 | | 2.75 | 1.25 |

| Domain | CDR3 | | | | | | FR4 |
|---|---|---|---|---|---|---|---|
| Kabat numbering | 100 | 100a | 100b | 100c | 101 | 102 | 105 |
| Amino acid before substitution (wt) | Y | Y | G | V | D | A | Q |
| A | 0.92 | 0.66 | | | 0.86 | | |
| D | 0.63 | 1.2 | 6.25 | 1.64 | | | |
| E | | | 7.29 | 1.31 | | | 0.89 |
| F | | 0.98 | 4.37 | | 0.73 | | |
| G | 0.97 | 1.01 | | | 3.16 | | |
| H | | | | | 0.91 | | |
| I | | | | | 1.73 | 1.29 | |
| K | 0.93 | 0.79 | | | 4.37 | | |
| L | 0.67 | 0.57 | 5.84 | | 0.71 | | |
| M | | | | | 1.94 | | |
| N | | | | | 2.28 | | |
| P | 1.3 | | | 0.97 | 43.42 | 3.51 | |
| Q | 0.77 | 0.51 | | | 3.55 | | |
| R | | | | | 5.66 | | |
| S | 0.7 | 0.59 | 1.25 | | 0.91 | | |
| T | | | | | 0.62 | | |
| V | 0.92 | | | | 1.18 | 1.27 | |
| W | 0.96 | | | | | | |
| Y | | | 51.41 | | 0.97 | 1 | |

12.3.2. Alteration of L Chain

Table 20 shows the results of the ratio of the amount of each L chain altered form bound to the amount of the corresponding unaltered antibody GLS3000 bound. Specifically, when the amount of the GLS3000-containing antibody bound was defined as X and the amount of the L chain one-amino acid altered form bound was defined as Y, a value of Z (ratio of amounts bound)=Y/X was used. As shown in FIG. 25, a very small amount bound was observed in the sensorgram for Z of less than 0.8, suggesting the possibility that the dissociation constant $K_D$ (M) cannot be calculated correctly. Table 21 shows the dissociation constant $K_D$ (M) ratio of each L chain altered form to GLS3000.

When Z shown in Table 20 is 0.8 or more, the altered form is considered to maintain the binding relative to the corresponding unaltered antibody GLS3000. Therefore, an antibody library designed such that these amino acids appear can serve as a dual Fab library.

| Domain | CDR1 | | | | | | | | | |
|---|---|---|---|---|---|---|---|---|---|---|
| Kabat numbering | 24 | 25 | 26 | 27 | 27a | 27b | 27c | 27d | 27e | 28 |
| Amino acid before substitution | R | S | S | Q | S | L | V | H | S | N |
| A | 0.86 | 0.92 | | | | | | 0.48 | 1.03 | 0.25 |
| D | 0.75 | 0.18 | 0.86 | 0.85 | 0.79 | 0.17 | 0.32 | 0.22 | 0.69 | 0.19 |
| E | 0.83 | 0.21 | 0.74 | 0.88 | 0.81 | 0.17 | 0.61 | 0.23 | 0.76 | 0.4 |
| F | | | | | | 0.42 | | 0.63 | 1.32 | 0.46 |
| G | 0.89 | | | | 1.03 | | | 0.3 | 1.04 | 0.46 |
| H | | | | | | | | | 1.23 | 0.42 |
| I | | 0.53 | | | 1 | 1.19 | 0.96 | 0.26 | 1.07 | 0.44 |
| K | | | | | | | | 0.29 | 1.59 | 0.44 |
| L | | 0.24 | | 0.92 | | | 0.84 | 0.3 | 1.17 | 0.39 |
| M | | 0.31 | | | | 0.7' | | 0.3 | 1.23 | 0.39 |
| N | | | | | 1.1 | | | 0.3 | 1.16 | |
| P | 0.7 | 1.01 | 0.78 | 0.29 | 0.99 | 0.9' | 0.3 | 0.24 | 1.26 | 0.36 |
| Q | 0.9 | | | | | | | 0.25 | 1.1 | 0.37 |
| R | | | | 1.19 | | | | 0.31 | 1.58 | |
| S | 0.89 | | | | | 0.7' | 0.51 | 0.32 | | 0.32 |
| T | 0.88 | 0.83 | | | | | | 0.29 | 0.97 | 0.45 |
| V | | 0.73 | | | | 1.12 | | 0.3 | 1.08 | 0.36 |
| W | | | | | | 0.26 | | 0.39 | 1.55 | 0.41 |
| Y | 0.87 | | | | 1.1 | 0.25 | 0.77 | 0.64 | 1.2 | 0.26 |

| Domain | CDR1 | | | | | | FR2 |
|---|---|---|---|---|---|---|---|
| Kabat numbering | 29 | 30 | 31 | 32 | 33 | 34 | 45 |
| Amino acid before substitution | R | N | T | Y | L | H | Q |
| A | 0.63 | 0.5 | | 0.24 | 0.85 | 1.06 | |
| D | 0.41 | 0.34 | 0.23 | 0.23 | 0.17 | 0.22 | 0.77 |
| E | | 0.44 | 0.49 | | 0.72 | 0.23 | 0.75 |
| F | | 1.1 | | 0.29 | 0.78 | 0.27 | |
| G | 0.67 | 0.47 | | | | 1.02 | |
| H | | 0.98 | | | | | |
| I | 0.37 | 0.61 | 0.97 | | 0.83 | 0.65 | |
| K | | 1.65 | 1.04 | | | 2.17 | |
| L | 0.56 | 0.7 | | | | 0.59 | |
| M | | 0.8 | | | 0.93 | 0.35 | |
| N | | | 0.32 | | | 0.65 | |
| P | 0.31 | 0.31 | 0.31 | 0.24 | 0.3 | 0.34 | |
| Q | | 0.87 | | | | 0.25 | 0.86 |
| R | | 1.86 | | | | 0.2 | |
| S | 0.68 | 0.29 | | | | 0.78 | |
| T | 0.63 | 0.29 | | | | 0.89 | |
| V | 0.34 | 0.61 | | | 1.05 | 0.85 | |
| W | | 0.99 | | | | 0.24 | |
| Y | 0.69 | 1.04 | | | | 0.59 | |

| Domain | CDR2 | | | | | | | FR3 | |
|---|---|---|---|---|---|---|---|---|---|
| Kabat numbering | 50 | 51 | 52 | 53 | 54 | 55 | 56 | 74 | 77 |
| Amino acid before substitution | K | V | S | N | R | F | S | K | R |
| A | 0.23 | | 0.93 | 0.61 | 0.69 | 1.13 | 1.16 | | |
| D | 0.22 | 0.33 | 0.63 | 0.34 | 0.36 | 0.65 | 0.77 | | |
| E | 0.24 | 0.64 | | 0.54 | 0.58 | 0.72 | 0.71 | | |
| F | | | | 0.69 | | | 1.32 | | |
| G | 0.16 | 0.84 | | 0.76 | 0.67 | 1.3' | 0.92 | | |
| H | | | | 1.18 | | 0.94 | 1.05 | | |
| I | | 0.81 | | 0.5 | | 0.82 | 0.99 | | |
| K | | | | 1.08 | | 1.33 | 1.46 | | |
| L | 0.24 | | | 0.56 | | 0.76 | 1.02 | | |
| M | | | | 0.62 | | 0.8 | 1.05 | | |
| N | | | | | | 0.98 | 0.92 | | |
| P | 0.3 | 0.32 | 0.33 | 0.81 | 0.84 | 1.16 | 0.95 | | |
| Q | 0.18 | | 1.05 | 0.77 | 0.68 | 0.9' | 1.04 | | |
| R | 0.5 | | | 1.58 | | 1.3' | 1.36 | | |
| S | 0.23 | | | 0.69 | 0.79 | 0.69 | | | 0.92 |
| T | 0.19 | | | 0.56 | 0.65 | 0.4' | 0.97 | 0.84 | |
| V | | | | 0.56 | | 0.7' | 0.95 | | |
| W | | | | 0.81 | 0.78 | 0.69 | 1.38 | | |
| Y | 0.24 | | 1.12 | 0.67 | | 0.92 | 1.46 | | |

-continued

| Domain | CDR3 | | | | | | | | FR4 |
|---|---|---|---|---|---|---|---|---|---|
| Kabat numbering | 89 | 90 | 91 | 92 | 93 | 94 | 95 | 96 | 97 | 107 |
| Amino acid before substitution | G | Q | G | T | Q | V | P | Y | T | K |
| A | 1.13 | 0.5 | 0.27 | 0.63 | 0.85 | 1.05 | 0.63 | | | |
| D | 0.33 | 0.19 | 0.16 | 0.18 | 0.72 | 0.89 | 0.24 | 0.17 | | |
| E | 0.26 | 0.86 | 0.16 | 0.17 | 0.75 | 0.5 | 0.39 | 0.17 | | 0.94 |
| F | 1.09 | | | | | 0.71 | | 1.17 | | |
| G | | | | | | 0.48 | 0.37 | | | |
| H | 0.7 | | | | | 0.78 | | 0.23 | | |
| I | 1.07 | | | 0.34 | | 0.66 | | | | |
| K | 0.4 | | | | | 0.57 | | | | |
| L | 0.94 | | | 0.42 | | 0.44 | 0.24 | 0.32 | | |
| M | 0.52 | | | | | 0.44 | | | | |
| N | 0.8 | | | | | 1.05 | | | | |
| P | 0.35 | 0.27 | 0.27 | 0.26 | 0.25 | 1.26 | | | 0.31 | |
| Q | 0.38 | | | | | 0.76 | | | | |
| R | 0.19 | | | | 1.13 | 0.66 | | | | |
| S | | 0.73 | 0.26 | 0.96 | 0.96 | 0.93 | 0.43 | | | |
| T | 1.03 | | 0.26 | | | 0.93 | | | | |
| V | 1.63 | | | | | | | | | |
| W | 0.5 | | | | | 0.58 | | | | |
| Y | 1.19 | 0.17 | 0.17 | 0.33 | 0.87 | 0.63 | | | | |

TABLE 21

| Domain | CDR1 | | | | | | | | |
|---|---|---|---|---|---|---|---|---|---|
| Kabat numbering | 24 | 25 | 26 | 27 | 27a | 27b | 27c | 27d | 27e |
| Amino acic before substitution | R | S | S | Q | S | L | V | H | S |
| Affinity up | 24 | 25 | 26 | 27 | 27a | 27b | 27c | 27d | 27e |
| A | 1 | 0.73 | | | | | | 2.57 | 1.01 |
| D | 0.83 | 8.86 | 1.06 | 0.89 | 0.94 | 25.07 | 3.21 | 13641 | 1.23 |
| E | 0.89 | 6.54 | 0.9 | 0.99 | 0.94 | 26.75 | 1.1 | 42.28 | 1.04 |
| F | | | | | | 2.67 | | 2.05 | 1.16 |
| G | 0.92 | | | | 0.8 | | | 3.51 | 1.03 |
| H | | | | | | | | | 1.09 |
| I | | 0.67 | | | 0.87 | 1.17 | 1.03 | 7.77 | 1.05 |
| K | | | | | | | | 3.8 | 1.32 |
| L | | 4.93 | | 0.86 | | | 0.81 | 3.37 | 1.06 |
| M | | 1.6 | | | | 1.31 | | 3.43 | 1.11 |
| N | | | | | 0.98 | | | 3.43 | 1.01 |
| P | 0.34 | 0.79 | 0.67 | 2.16 | 1.01 | 0.96 | 3.71 | 9.21 | 1.06 |
| Q | 0.87 | | | | | | | 7.48 | 1.08 |
| R | | | | 1.06 | | | | 2.35 | 1.35 |
| S | 0.97 | | | | | 0.9 | 3.04 | 3.05 | |
| T | 1.03 | 0.75 | | | | | | 12973 | 0.98 |
| V | | 0.74 | | | | 1.11 | | 353.86 | 0.95 |
| W | | | | | | 23.6 | | 1.86 | 1.32 |
| Y | 0.94 | | | | 0.93 | 22.2 | 1.25 | 1.98 | 1.1 |

| Domain | CDR1 | | | | | | | FR2 |
|---|---|---|---|---|---|---|---|---|
| Kabat numbering | 28 | 29 | 30 | 31 | 32 | 33 | 34 | 45 |
| Amino acic before substitution | N | R | N | T | Y | L | H | Q |
| Affinity up | 28 | 29 | 30 | 31 | 32 | 33 | 34 | 45 |
| A | 4.18 | 1.15 | 1.16 | | 66.77 | 0.82 | 1.18 | |
| D | 4455.11 | 1.58 | 3.82 | 30.86 | 25.92 | 37.53 | 2100 | 0.86 |
| E | 5.47 | | 2.83 | 1.59 | | 0.83 | 8.03 | 1.01 |
| F | 2.59 | | f | | 4.51 | 0.65 | 3.5 | |
| G | 2.41 | 0.62 | 2.1 | | | | 1.08 | |
| H | 3 | | 1.08 | | | | | |
| I | 2.81 | 1.6 | 1.24 | 1.1 | | 0.86 | 0.89 | |
| K | 2.34 | | 1.35 | 0.88 | | | 4.1 | |
| L | 3.34 | 0.9 | 1.19 | | | | 1.03 | |
| M | 3.29 | | 1.2 | | | 0.9 | 3.16 | |
| N | | | | 4.46 | | | 2.84 | |
| P | 4.18 | 14.01 | 12.14 | 10.82 | 61.98 | 32.66 | 1.22 | |
| Q | 3.48 | | 1 | | | | 4.6 | 0.98 |
| R | | | 1.73 | | | | 85764 | |
| S | 4.3 | 1.05 | 10.64 | | | | 1.24 | |

TABLE 21-continued

| | | | | | | | | | |
|---|---|---|---|---|---|---|---|---|---|
| T | 2.67 | 1.02 | 12.72 | | | 1.1 | | | |
| V | 3.73 | 2.25 | 2.62 | | 1.26 | 1.04 | | | |
| W | 3.17 | | 0.97 | | | 8.45 | | | |
| Y | 3.89 | 1.08 | 1.03 | | | 2.44 | | | |

| Domain | CDR2 | | | | | | | FR3 | |
|---|---|---|---|---|---|---|---|---|---|
| Kabat numbering | 50 | 51 | 52 | 53 | 54 | 55 | 56 | 74 | 77 |
| Amino acid before substitution | K | V | S | N | R | F | S | K | R |
| Affinity up | 50 | 51 | 52 | 53 | 54 | 55 | 56 | 74 | 77 |
| A | 59.5 | | 0.9 | 0.82 | 0.85 | 1.16 | 1.18 | | |
| D | 114 | 1.5 | 0.94 | 2.8 | 1.8 | 1.02 | 1.11 | | |
| E | 57.2 | 0.88 | | 2.47 | 0.84 | 0.92 | 0.91 | | |
| F | | | | 0.96 | | | 1.12 | | |
| G | 42.4 | 0.83 | | 1.33 | 0.88 | 1.15 | 0.99 | | |
| H | | | | 1.31 | | 1.02 | 0.96 | | |
| I | | 0.69 | | 2.69 | | 1.28 | 1.01 | | |
| K | | | | 1.05 | | 1.22 | 1.21 | | |
| L | 36.4 | | | 1.62 | | 1.43 | 1.03 | | |
| M | | | | 1.21 | | 1.29 | 0.93 | | |
| N | | | | | | 0.91 | 0.9 | | |
| P | 27.7 | 6 | 7.38 | 0.98 | 1.05 | 1.15 | 0.98 | | |
| Q | 8.13 | | 1.01 | 1.28 | 1.04 | 1.09 | 0.97 | | |
| R | 1.83 | | | 1.56 | | 1.27 | 1.15 | | |
| S | 45.3 | | | 0.88 | 0.78 | 1.15 | | | 0.94 |
| T | 25.1 | | | 2.68 | 0.89 | 2.42 | 1.01 | 0.85 | |
| V | | | | 2.14 | | 1.12 | 0.94 | | |
| W | | | | 1.01 | 0.65 | 1.72 | 1.12 | | |
| Y | 195 | | 1.02 | 0.99 | | 1.13 | 1.1 | | |

| Domain | CDR3 | | | | | | | | | FR4 |
|---|---|---|---|---|---|---|---|---|---|---|
| Kabat numbering | 89 | 90 | 91 | 92 | 93 | 94 | 95 | 96 | 97 | 107 |
| Amino acid before substitution | G | Q | G | T | Q | V | P | Y | T | K |
| Affinity up | 89 | 90 | 91 | 92 | 93 | 94 | 95 | 96 | 97 | 107 |
| A | 1.1 | 0.89 | 28.14 | 1.35 | 0.65 | 1.05 | 0.87 | | | |
| D | 1.96 | 11.13 | 44.76 | 11.19 | 0.72 | 1.05 | 2.37 | 40.88 | | |
| E | 34.63 | 0.91 | 48.54 | 19.56 | 1.05 | 1.18 | 1.01 | 46.81 | | 0.95 |
| F | 3.34 | | | | | 1.75 | | 0.86 | | |
| G | | | | | | 2.59 | 1.94 | | | |
| H | 1.44 | | | | | 1.16 | | 80.34 | | |
| I | 1.11 | | | 1.91 | | 1.46 | | | | |
| K | 1.8 | | | | | 0.91 | | | | |
| L | 2.38 | | | 1.61 | | 3.06 | 11.66 | 1.84 | | |
| M | 1.96 | | | | | 2.74 | | | | |
| N | 1.2 | | | | | 0.96 | | | | |
| P | 1.8 | 15.86 | 23.05 | 26.71 | 39.54 | 1.1 | | | 3.35 | |
| Q | 2.11 | | | | | 1.1 | | | | |
| R | 4127.4 | | | | 0.79 | 1.11 | | | | |
| S | | 0.96 | 72076 | 0.81 | 0.75 | 0.81 | 1.19 | | | |
| T | 1.1 | | 39.87 | | | 1.06 | | | | |
| V | 1.4 | | | | | | | | | |
| W | 2.2 | | | | | 1.81 | | | | |
| Y | 1.12 | 36.29 | 33.84 | 2.55 | 0.76 | 2.45 | | | | |

12.4 Evaluation of Binding of One-Amino Acid Alteration Antibody to ECM (Extracellular Matrix)

ECM (extracellular matrix) is an extracellular constituent and resides at various sites in vivo. Therefore, an antibody strongly binding to ECM is known to have poorer kinetics in blood (shorter half-life) (WO2012093704 A1). Thus, amino acids that do not enhance ECM binding are preferably selected as the amino acids that appear in the antibody library.

Each antibody was obtained as an H chain or L chain altered form by the method described in the Reference Example 1.2. Next, its ECM binding was evaluated according to the method of Reference Example 14. The ECM binding value (ECL reaction) of each altered form was divided by the ECM binding value of the antibody MRA (H chain: SEQ ID NO: 189, L chain: SEQ ID NO: 190) obtained in the same plate or at the same execution date, and the resulting value is shown in Tables 22 (H chain) and 23 (L chain). As shown in Tables 22 and 23, some alterations were confirmed to have tendency to enhance ECM binding.

Of the values shown in Tables 22 (H chain) and 23 (L chain), an effective value up to 10 times was adopted to the dual Fab library in consideration of the effect of enhancing ECM binding by a plurality of alterations.

| Domain | FR1 | | | | | | CDR1 | | | | FR2 | CDR2 | | | |
|---|---|---|---|---|---|---|---|---|---|---|---|---|---|---|---|
| Kabat numbering | 11 | 16 | 19 | 28 | 29 | 30 | 31 | 32 | 33 | 35 | 43 | 50 | 51 | 52 | 52a |
| Amino acid before substitution | V | R | R | T | F | S | N | A | W | H | K | Q | I | K | A |
| A | | | | | | | | | | | | | | | |
| D | | | | 0.913 | | 1.11 | | | | 1.1 | | 1.06 | 4.75 | 1.07 | 1.66 |
| E | | 1.14 | | | | | | | | 1.04 | 1.8 | 1.08 | 4.55 | 1.18 | 1.19 |
| F | | | | | | | | | | 2.62 | | | | | |
| G | | | | | | 3.32 | | | | 8.82 | | | | | 4.72 |
| H | | | | | | | | | | | | | | | |
| I | | | | | | | 2.51 | | | | | | | | |
| K | | | | | | | 41.37 | | | | | | | | |
| L | 3.41 | | | | | | | | | | | | | | |
| M | | | | | | | | | | 4.69 | | | | | |
| N | | | | | | | | | | 3.06 | | | | | |
| P | | | | | | | | | | 51.18 | | | | | |
| Q | | 1.55 | | | | | | | | | 2 | | | | |
| R | | | | | | | 71.66 | | | | | | | 11.19 | |
| S | | | | 2.32 | | | 0.95 | | | | | | | | 3.34 |
| T | | | 1.17 | | | | | | | 3.49 | | | | | |
| V | | | | | 17.13 | | | | | 7.32 | | | | | |
| W | | | | | | | | | | 8.8 | | | | | |
| Y | | | | | | | | | | | | | | | |

| Domain | CDR2 | | | | | | | | | | | | | |
|---|---|---|---|---|---|---|---|---|---|---|---|---|---|---|
| Kabat numbering | 52b | 52c | 53 | 54 | 55 | 56 | 57 | 58 | 59 | 60 | 61 | 62 | 64 | 65 |
| Amino acid before substitution | K | S | N | N | Y | A | T | Y | Y | A | E | S | K | G |
| A | | 2.95 | | 4.5 | | | 4.67 | | 5.82 | | 7.23 | | 2.08 | |
| D | | | | | | | | | 2.77 | 4.02 | 3.23 | 4.4 | 1.23 | 0.91 |
| E | | | | | | | | | 2.33 | 4.36 | | 2.75 | 1.33 | 2.13 |
| F | | 10.46 | | 15.16 | | | | | | | | | | |
| G | | 5.41 | | 4.43 | | | | | | | | | | |
| H | | | | | | | | | | | | | | |
| I | | | | | | | | | | | | | | |
| K | | 58.7 | | 85.86 | | 32.07 | 16.29 | | | | | 4.07 | | |
| L | | 4.07 | | 6.02 | | 3.56 | | | | | | | | |
| M | | | | | | | | | | | | | | |
| N | | | | | | 4.07 | 4.49 | | | | | | | |
| P | | | | | | | | | | | 9.99 | 3.83 | | |
| Q | | 4.99 | 3.18 | 3.23 | | | | | | | 9.29 | | 1.91 | |
| R | 7.28 | | | | | | | | | | | | | |
| S | | | 3.71 | 4.33 | | | | | 6.58 | | | | 1.89 | |
| T | | | | | | | | | | | | | | |
| V | | 3.23 | | | | | | | | | | | | |
| W | | | 23.56 | | | | | | | | | | | |
| Y | | 19.56 | | 17.47 | | | | | | | | | | |

| Domain | FR3 | | | | | | | | CDR3 | | | |
|---|---|---|---|---|---|---|---|---|---|---|---|---|
| Kabat numbering | 72 | 73 | 74 | 75 | 76 | 77 | 78 | 82a | 95 | 96 | 97 | 98 |
| Amino acid before substitution | D | D | S | K | N | S | L | N | V | H | Y | G |
| A | 22.3 | | | | | | | | | | | 2.7 |
| D | | | | | | | | 1.12 | 0.96 | | 0.65 | |
| E | | | | | | | | | 0.76 | | | |
| F | | | | | | | | | | | | |
| G | | | | | | | | | | | | |
| H | | | | | | | | | | | | 2.12 |
| I | | | | | | | | | | | | |
| K | | | | | | | | | | | | 32.29 |
| L | | | | | | | | | | | | |
| M | | | | | | | | | | | | |
| N | | | | | | | | | | | | |
| P | | | | | | | | | | | | 3 |
| Q | | | | | | | | | | | | 2.99 |
| R | | | | 2.92 | | | | | | | | 48.83 |
| S | | | | | 1.93 | | | | | | | 2.41 |
| T | | | | 1.2 | | 2.31 | | | | | | 1.6 |
| V | | | | | | | | | | | | |
| W | | | | | | | | | | | | |
| Y | | | | | | | | | | | | 27.01 |

-continued

| Domain | CDR3 | | | | | | | FR4 |
|---|---|---|---|---|---|---|---|---|
| Kabat numbering | 99 | 100 | 100a | 100b | 100c | 101 | 102 | 105 |
| Amino acid before substitution | A | Y | Y | G | V | D | A | Q |
| A | | 1.46 | | | | 66.85 | | |
| D | | | | 0.98 | 1.18 | | | |
| E | | | | 1.2 | 1.3 | | | 1.33 |
| F | 16.97 | | 2.81 | | | | | |
| G | | 1 | 2.61 | | | 56.66 | | |
| H | | | | | | 16.16 | | |
| I | | | | | | 63.16 | 6.63 | |
| K | 57.13 | 8.2 | 10.3 | | | 38.94 | | |
| L | 6.94 | | | | | | | |
| M | | | | | | 123.87 | | |
| N | | | | | | 90.66 | | |
| P | | | | | | | | |
| Q | 2.12 | 0.94 | | | | 130.29 | | |
| R | | | | | | | | |
| S | 3.34 | 1 | | | | 58.7 | | |
| T | 2.54 | | | | | | | |
| V | | | | | | 48.47 | 6.29 | |
| W | | 10.83 | | | | | | |
| Y | 30.37 | | | | | | 2.82 | |

TABLE 23

| Domain Kabat | CDR1 | | | | | | | | | | | | | | | | FR2 |
|---|---|---|---|---|---|---|---|---|---|---|---|---|---|---|---|---|---|
| numbering | 24 | 25 | 26 | 27 | 27a | 27b | 27c | 27d | 27e | 28 | 29 | 30 | 31 | 32 | 33 | 34 | 45 |
| Amino acid before substitution | R | S | S | Q | S | L | V | H | S | N | R | N | T | Y | L | H | Q |
| A | 2.62 | 2.28 | | | | | | | 3.25 | | 0.87 | | | 2.21 | 5.92 | 2.61 | |
| D | 1.86 | 1.01 | 1.31 | 1.3 | 1.03 | 1.16 | 0.76 | | | | 0.64 | | 0.66 | 0.98 | 0.6 | | 0.99 |
| E | 2.02 | 1.16 | 1.22 | 1.24 | 1.12 | 1.04 | 0.72 | | 1.19 | | | | 0.79 | | 1.45 | | 1.15 |
| F | | | | | | | | | 16.43 | | | 5.79 | | 1.55 | | | |
| G | 1.53 | | | | 10.04 | | | | 5.42 | | | | | | | 3.9 | |
| H | | | | | | | | | 13.64 | | | 8.6 | | | | | |
| I | | | | | 11.11 | 2.68 | 56.75 | | 4.28 | | | | 2.87 | | 4.74 | | |
| K | | | | | | | | | 34.74 | | | 31.93 | 59.62 | | | 84.66 | |
| L | | | | 11.8 | | | 3.16 | | 5.89 | | | | | | | | |
| M | | | | | | | | | 6.53 | | | 3.32 | | | 19.8 | | |
| N | | | | | 48.45 | | | | 4.63 | | | | | | | | |
| P | | 2.83 | | | 2.3 | 2.7 | | | 7.26 | | | | | | | | |
| Q | 1.26 | | | | | | | | 2.58 | | | 3.45 | | | | | 2.31 |
| R | | | | 18.19 | | | | | 74.03 | | | 69.62 | | | | | |
| S | 2.65 | | | | | 3.3 | | | | | | | | | | 2.17 | |
| T | 1.8 | 2.7 | | | | | | | 2.32 | | 0.63 | | | | | 4.51 | |
| V | | | | | | 2.82 | | | 2.31 | | | | | | 2.68 | 6.43 | |
| W | | | | | | | | | 46.73 | | | 11.21 | | | | | |
| Y | 1.89 | | | | 42.7 | | | | 30.66 | | | 3.08 | | | | | |

| Domain Kabat | CDR2 | | | | | | | FR3 | | CDR3 | | | | | | | | | FR4 |
|---|---|---|---|---|---|---|---|---|---|---|---|---|---|---|---|---|---|---|---|
| numbering | 50 | 51 | 52 | 53 | 54 | 55 | 56 | 74 | 77 | 89 | 90 | 91 | 92 | 93 | 94 | 95 | 96 | 97 | 107 |
| Amino acid before substitution | K | V | S | N | R | F | S | K | R | G | Q | G | T | Q | V | P | Y | T | K |
| A | 0.83 | | 3.65 | | 1.78 | 2.41 | 16.89 | | | 8.43 | 3.14 | | 3.11 | 3.34 | 3.22 | | | | |
| D | 0.64 | 1.01 | | | 1.44 | | | | | | 1.37 | 0.8 | 0.84 | | 0.88 | 4.38 | 0.66 | | |
| E | | 0.95 | | | 0.94 | | | | | | 2.55 | 1 | 0.67 | 0.85 | | 3.71 | 0.59 | | 2.96 |
| F | | | | | | | 10.25 | | | 31.93 | | | | | | | 3.44 | | |
| G | 0.67 | 3.5 | | | 1.19 | 6.49 | 3.26 | | | | | | | | | | | | |
| H | | | | 4.88 | | 7.39 | 6.83 | | | | | | | | | | | | |
| I | | 2.11 | | | | 23.25 | 5.1 | | | 14.58 | | | | | | | | | |
| K | | | | 19.31 | | 5.18 | 31.33 | | | | | | | | | | | | |
| L | | | | | | | 5.65 | | | 18.53 | | | | | | | | | |
| M | | | | | | 12.14 | 5.15 | | | | | | | | | | | | |
| N | | | | | | 7.83 | 3.96 | | | 4.96 | | | | | 3.01 | | | | |

TABLE 23-continued

| | | | | | | | | | | | | | | |
|---|---|---|---|---|---|---|---|---|---|---|---|---|---|---|
| P | | | 4.72 | 5.49 | 5.16 | 6 | | | | | | | | 10.7 |
| Q | 0.76 | 2.37 | | 1.33 | 35.06 | 2.96 | | | | | | | | |
| R | | | 34.13 | | 16.5 | 19.76 | | | | | | | 44.29 | |
| S | 0.84 | | | | | | | 2.37 | | 4.37 | | 3.12 | 3.82 | 3.78 |
| T | 1.03 | | | 1.39 | | 2.48 | 2.05 | | 6.79 | | | | | 2.63 |
| V | | | | | | 4 | | | 26.88 | | | | | |
| W | | | 2.19 | | | 26.63 | | | | | | | | |
| Y | 0.88 | 6.28 | | | 6.18 | 3.87 | | | 28.25 | 3.75 | 3.26 | 2.96 | 14.49 | |

12.5. Study on Insertion Site and Length of Peptide for Enhancing Diversity of Library Reference Example 11 showed that a peptide can be inserted to each site using a GGS sequence without canceling binding to CD3 (CD3 epsilon). If loop extension is possible for the dual Fab library, the resulting library might include more types of molecules (or have larger diversity) and permit obtainment of Fab domains binding to diverse second antigens. Thus, in view of presumed reduction in binding activity caused by peptide insertion. V11L/D72A/L78//D101Q alteration to enhance binding activity against CD3 epsilon was added to the CE115HA000 sequence, which was further linked to pE22Hh. A molecule was prepared by the insertion of the GGS linker to this sequence, as in Reference Example 11, and evaluated for its CD3 binding. The GGS sequence was inserted between Kabat numbering positions 99 and 100. The antibody molecule was expressed as a one-arm antibody. Specifically, the GGS linker-containing H chain mentioned above and Kn010G3 (SEQ ID NO: 188) were used as H chains, and GLS3000 (SEQ ID NO: 185) linked to the kappa sequence (SEQ ID NO: 187) was adopted as an L chain. These sequences were expressed and purified according to Reference Example 9.

12.6. Confirmation of Binding of GGS Peptide-Inserted CE115 Antibody to CD3

The binding of the GGS peptide-inserted altered antibody to CD3 epsilon was confirmed using Biacore by the method described in Reference Example 11. As shown in Table 24, the results demonstrated that the GGS linker can be inserted to loops. Particularly, the GGS linker was able to be inserted to the H chain CDR3 region, which is important for antigen binding, and the binding to CD3 epsilon was maintained as a result of any of the 3-, 6-, and 9-amino acid insertions. Although this study was conducted using the GGS linker, an antibody library in which various amino acids other than GGS appear may be acceptable.

TABLE 24

| Inserted amino acid sequence (99-100) | CD3_KD [M] |
|---|---|
| GGS | 6.31E-08 |
| GGSGGS (SEQ ID NO: 175) | 3.46E-08 |
| GGSGGS (SEQ ID NO: 175) | 3.105E-08 |
| GGSGGGS (SEQ ID NO: 191) | 4.352E-08 |
| GGSGGGS (SEQ ID NO: 191) | 3.429E-08 |
| GGGSGGGS (SEQ ID NO: 192) | 4.129E-08 |
| GGGSGGGS (SEQ ID NO: 192) | 3.753E-08 |

TABLE 24-continued

| Inserted amino acid sequence (99-100) | CD3_KD [M] |
|---|---|
| GGSGGSGGS (SEQ ID NO: 177) | 4.39E-08 |
| GGSGGSGGS (SEQ ID NO: 177) | 3.537E-08 |
| No insertion | 6.961E-09 |
| CE115HA000 | 1.097E-07 |

12.7. Study on Insertion for Library to H Chain CDR3 Using NNS Nucleotide Sequence The paragraph (12.6) showed that the 3, 6, or 9 amino acids can be inserted using the GGS linker, and inferred that a library having the 3-, 6-, or 9-amino acid insertion can be prepared to obtain an antibody binding to the second antigen by use of a usual antibody obtainment method typified by the phage display method. Thus, a study was conducted on whether the 6-amino acid insertion to CDR3 could maintain binding to CD3 even if various amino acids appeared at the 6-amino acid insertion site using an NNS nucleotide sequence (which allows every type of amino acid to appear). In view of presumed reduction in binding activity, primers were designed using the NNS nucleotide sequence such that 6 amino acids were inserted between positions 99 and 100 (Kabat numbering) in CDR3 of a CE115HA340 sequence (SEQ ID NO: 193) having higher CD3 epsilon-binding activity than that of CE115HA000. The antibody molecule was expressed as a one-arm antibody.

Specifically, the altered H chain mentioned above and Kn010G3 (SEQ ID NO: 188) were used as H chains, and GLS3000 (SEQ ID NO: 185) linked to the kappa sequence (SEQ ID NO: 187) was adopted as an L chain. These sequences were expressed and purified according to Reference Example 9. The obtained altered antibody was evaluated for its binding by the method described in the Reference Example 12.6. The results are shown in Table 25. The results demonstrated that the binding activity against CD3 (CD3 epsilon) is maintained even if various amino acids appear at the site extended with the amino acids. Table 26 shows results of further evaluating the presence or absence of enhancement in nonspecific binding by the method described in Reference Example 10. As a result, the binding to ECM was enhanced if the extended loop of CDR3 was rich in amino acids having a positively charged side chain. Therefore, it was desired that three or more amino acids having a positively charged side chain should not appear in the loop.

TABLE 25

| VH | CD3_KD[M] | CDR 3 | | | | | | | | | | | | | | | | | | |
|---|---|---|---|---|---|---|---|---|---|---|---|---|---|---|---|---|---|---|---|---|
| | | 9 | | | | | 1 0 | | | | | | | | | | | | | |
| CE115HA340 | 2.0E-08 | 5 | 6 | 7 | 8 | 9 | 0 | a | b | c | d | e | f | g | h | i | k | 1 | 1 | 2 |
| CE115HA340 | 2.7E-08 | V | H | Y | A | A | X | X | X | X | X | X | Y | Y | G | V | — | — | D | A |
| NNS6f17 | 7.4E-08 | . | . | . | . | . | W | G | E | G | V | V | . | . | . | . | . | . | . | . |
| NNS6f27 | 3.8E-08 | . | . | . | . | . | V | W | G | S | V | W | . | . | . | . | . | . | . | . |
| NNS6f29 | 9.0E-08 | . | . | . | . | . | I | Y | Y | P | T | N | . | . | . | . | . | . | . | . |
| NNS6f47 | 3.1E-08 | . | . | . | . | . | H | F | M | W | W | G | . | . | . | . | . | . | . | . |
| NNS6f50 | 7.1E-08 | . | . | . | . | . | L | T | G | G | L | G | . | . | . | . | . | . | . | . |
| NNS6f51 | 3.1E-08 | . | . | . | . | . | G | F | L | V | L | W | . | . | . | . | . | . | . | . |
| NNS6f52 | 5.2E-08 | . | . | . | . | . | Y | M | L | G | L | G | . | . | . | . | . | . | . | . |
| NNS6f54 | 2.9E-08 | . | . | . | . | . | F | E | W | V | G | W | . | . | . | . | . | . | . | . |
| NNS6f55 | 3.1E-08 | . | . | . | . | . | A | G | R | W | L | A | . | . | . | . | . | . | . | . |
| NNS6f56 | 2.1E-08 | . | . | . | . | . | R | E | A | T | R | W | . | . | . | . | . | . | . | . |
| NNS6f58 | 4.4E-08 | . | . | . | . | . | S | W | Q | V | S | R | . | . | . | . | . | . | . | . |
| NNS6f59 | 2.0E-07 | . | . | . | . | . | L | L | V | Q | E | G | . | . | . | . | . | . | . | . |
| NNS6f62 | 6.1E-08 | . | . | . | . | . | N | G | G | T | R | H | . | . | . | . | . | . | . | . |
| NNS6f63 | 6.9E-08 | . | . | . | . | . | G | G | G | G | W | V | . | . | . | . | . | . | . | . |
| NNS6f64 | 7.8E-08 | . | . | . | . | . | L | V | S | L | T | V | . | . | . | . | . | . | . | . |
| NNS6f67 | 3.6E-08 | . | . | . | . | . | G | L | L | R | A | A | . | . | . | . | . | . | . | . |
| NNS6f68 | 4.5E-08 | . | . | . | . | . | V | E | W | G | R | W | . | . | . | . | . | . | . | . |
| NNS6f71 | 5.1E-08 | . | . | . | . | . | G | W | V | L | G | S | . | . | . | . | . | . | . | . |
| NNS6f72 | 1.5E-07 | . | . | . | . | . | E | G | I | W | W | G | . | . | . | . | . | . | . | . |
| NNS6f73 | 2.6E-08 | . | . | . | . | . | W | V | V | G | V | R | . | . | . | . | . | . | . | . |

TABLE 26

| | ECL reaction | | Ratio | CDR 3 | | | | | | | | | | | | | | | | | | |
|---|---|---|---|---|---|---|---|---|---|---|---|---|---|---|---|---|---|---|---|---|---|---|
| H chain | ECM 3 µg/ml | MRA | ECM vs MRA | 9 5 | 6 | 7 | 8 | 9 | 1 0 0 | 0 a | b | c | d | e | f | g | h | i | k | 1 | 1 | 2 |
| CE115HA340 | 394 | 448 | 0.9 | V | H | Y | A | A | X | X | X | X | X | X | Y | Y | G | V | — | — | D | A |
| NNS6f17 | 409 | 448 | 0.9 | . | . | . | . | . | W | G | E | G | V | V | . | . | . | . | . | . | . | . |
| NNS6f27 | 3444 | 448 | 7.7 | . | . | . | . | . | V | W | G | S | V | W | . | . | . | . | . | . | . | . |
| NNS6f29 | 481 | 448 | 1.1 | . | . | . | . | . | I | Y | Y | P | T | N | . | . | . | . | . | . | . | . |
| NNS6f47 | 94137 | 448 | 210.3 | . | . | . | . | . | H | F | M | W | W | G | . | . | . | . | . | . | . | . |
| NNS6f50 | 385 | 564 | 0.7 | . | . | . | . | . | L | T | G | G | L | G | . | . | . | . | . | . | . | . |
| NNS6f51 | 20148 | 564 | 35.7 | . | . | . | . | . | G | F | L | V | L | W | . | . | . | . | . | . | . | . |
| NNS6f52 | 790 | 564 | 1.4 | . | . | . | . | . | Y | M | L | G | L | G | . | . | . | . | . | . | . | . |
| NNS6f54 | 1824 | 564 | 3.2 | . | . | . | . | . | F | E | W | V | G | W | . | . | . | . | . | . | . | . |
| NNS6f55 | 14183 | 564 | 25.1 | . | . | . | . | . | A | G | R | W | L | A | . | . | . | . | . | . | . | . |
| NNS6f56 | 6534 | 564 | 11.6 | . | . | . | . | . | R | E | A | T | R | W | . | . | . | . | . | . | . | . |

TABLE 26-continued

| | ECL reaction | | Ratio | CDR 3 | | | | | | | | | | | | | | | | | | |
|---|---|---|---|---|---|---|---|---|---|---|---|---|---|---|---|---|---|---|---|---|---|---|
| | ECM 3 | | ECM vs | 9 | | | | | 1 | 0 | | | | | | | | | | | | |
| H chain | µg/ml | MRA | MRA | 5 | 6 | 7 | 8 | 9 | 0 | a | b | c | d | e | f | g | h | i | k | 1 | 1 | 2 |
| NNS6f58 | 2700 | 564 | 4.8 | . | . | . | . | . | S | W | Q | V | S | R | . | . | . | . | . | . | . | . |
| NNS6f59 | 388 | 564 | 0.7 | . | . | . | . | . | L | L | V | Q | E | G | . | . | . | . | . | . | . | . |
| NNS6f62 | 554 | 564 | 1.0 | . | . | . | . | . | N | G | G | T | R | H | . | . | . | . | . | . | . | . |
| NNS6f63 | 624 | 564 | 1.1 | . | . | . | . | . | G | G | G | G | W | V | . | . | . | . | . | . | . | . |
| NNS6f64 | 603 | 564 | 1.1 | . | . | . | . | . | L | V | S | L | T | V | . | . | . | . | . | . | . | . |
| NNS6f67 | 1292 | 564 | 2.3 | . | . | . | . | . | G | L | L | R | A | A | . | . | . | . | . | . | . | . |
| NNS6f68 | 2789 | 564 | 4.9 | . | . | . | . | . | V | E | W | G | R | W | . | . | . | . | . | . | . | . |
| NNS6f71 | 618 | 564 | 1.1 | . | . | . | . | . | G | W | V | L | G | S | . | . | . | . | . | . | . | . |
| NNS6f72 | 536 | 564 | 0.9 | . | . | . | . | . | E | G | I | W | W | G | . | . | . | . | . | . | . | . |
| NNS6f73 | 2193 | 564 | 3.9 | . | . | . | . | . | W | V | V | G | V | R | . | . | . | . | . | . | . | . |

12.8. Design and Construction of Dual Fab Library

On the basis of the study described in Reference Example 12, an antibody library (dual Fab library) for obtaining an antibody binding to CD3 and the second antigen was designed as follows:

- step 1: selecting amino acids that maintain the ability to bind to CD3 (CD3 epsilon) (to secure 80% or more of the amount of CE115HA000 bound to CD3);
- step 2: selecting amino acids that keep ECM binding within 10 times that of MRA compared with before alteration; and
- step 3: inserting 6 amino acids to between positions 99 and 100 (Kabat numbering) in H chain CDR3.

The antigen-binding site of Fab can be diversified by merely performing the step 1. The resulting library can therefore be used for identifying an antigen-binding molecule binding to the second antigen. The antigen-binding site of Fab can be diversified by merely performing the steps 1 and 3. The resulting library can therefore be used for identifying an antigen-binding molecule binding to the second antigen. Even library design without the step 2 allows an obtained molecule to be assayed and evaluated for ECM binding.

Thus, for the dual Fab library, sequences derived from CE115HA000 by adding the V11L/L781 mutation to FR (framework) and further diversifying CDRs as shown in Table 27 were used as H chains, and sequences derived from GLS3000 by diversifying CDRs as shown in Table 28 were used as L chains. These antibody library fragments can be synthesized by a DNA synthesis method generally known to those skilled in the art. The dual Fab library may be prepared as (1) a library in which H chains are diversified as shown in Table 27 while L chains are fixed to the original sequence GLS3000 or the L chain having enhanced CD3 epsilon binding described in Reference Example 12, (2) a library in which H chains are fixed to the original sequence (CE115HA000) or the H chain having enhanced CD3 epsilon binding described in Reference Example 1 while L chains are diversified as shown in Table 28, and (3) a library in which H chains are diversified as shown in Table 27 while L chains are diversified as shown in Table 28. The H chain library sequences derived from CE115HA000 by adding the V11L/L781 mutation to FR (framework) and further diversifying CDRs as shown in Table 27 were entrusted to the DNA synthesizing company DNA2.0, Inc, to obtain antibody library fragments (DNA fragments). The obtained antibody library fragments were inserted to phagemids for phage display amplified by PCR. GLS3000 was selected as L chains. The constructed phagemids for phage display were transferred to *E. coli* by electroporation to prepare *E. coli* harboring the antibody library fragments.

Based on Table 28 we designed the new diversified library for GLS3000 as shown in Table 29. The L chain library sequences was derived from GLS3000 and diversified as shown in Table 29 (DNA library). The DNA library was constructed by DNA synthesizing company. Then the L chain library containing various GLS3000 derived sequences and the H chain library containing various CE115HA000 derived sequences were inserted into phagemid to construct phage display library.

| | CDR1 | | | | | CDR2 | | | | | | | | | | | | | | | | | | |
|---|---|---|---|---|---|---|---|---|---|---|---|---|---|---|---|---|---|---|---|---|---|---|---|---|
| Kabat | 3 | | | | | 5 | | 5 | | | | | | | | | | | 6 | | | | | |
| numbering | 1 | 2 | 3 | 4 | 5 | 0 | 1 | 2 | a | b | c | 3 | 4 | 5 | 6 | 7 | 8 | 9 | 0 | 1 | 2 | 3 | 4 | 5 |
| Before substitution | N | A | W | M | H | Q | I | K | A | K | S | N | N | Y | A | T | Y | Y | A | E | S | V | K | G |
| Library | I | A | W | M | H | Q | I | K | D | R | A | Q | A | Y | L | A | Y | Y | A | P | S | V | K | G |
| | N | | | | | | | | | K | G | S | G | | N | N | | | | E | | | | |
| | S | | | | | | | | | | L | N | L | | A | T | | | | | | | | |
| | | | | | | | | | | | Q | | Q | | | | | | | | | | | |

-continued

| | | | | | | | | | | | | | | | | | |
|---|---|---|---|---|---|---|---|---|---|---|---|---|---|---|---|---|---|
| | | | | V | | S | | | | | | | | | | | |
| | | | | S | | N | | | | | | | | | | | |

| | CDR3 | | | | | | | | | | | | | | | | |
|---|---|---|---|---|---|---|---|---|---|---|---|---|---|---|---|---|---|
| Kabat | 9 | | | | | 10 | | | | | | | | | | | |
| numbering | 5 | 6 | 7 | 8 | 9 | 0 | a | b | c | d | e | f | g | h | i | 1 | 2 |
| Before substitution | V | H | Y | G | A | x | x | x | x | x | x | Y | Y | G | V | D | A |
| Library | V | H | Y | A | A | A | A | G | A | L | P | A | Y | G | V | D | A |
| | | | | G | L | V | V | S | V | G | G | S | F | | | | |
| | | | | P | S | G | G | T | L | S | S | Q | G | | | | |
| | | | | S | Q | S | S | Y | G | Y | Y | K | | | | | |
| | | | | T | T | T | T | F | S | F | F | Y | | | | | |
| | | | | Q | | Y | Y | D | Y | | | G | | | | | |
| | | | | H | | F | F | | F | | | | | | | | |
| | | | | | | | D | | | | | | | | | | |

TABLE 28

| Domain | CDR1 | | | | | | | | | | | | | | | FR2 |
|---|---|---|---|---|---|---|---|---|---|---|---|---|---|---|---|---|
| Kabat | 2 | | | | | | | | | | | 3 | | | | 4 |
| numbering | 4 | 5 | 6 | 7 | a | b | c | d | e | 8 | 9 | 0 | 1 | 2 | 3 | 4 | 5 |
| Before substitution | R | S | S | Q | S | L | V | H | S | N | R | N | T | Y | L | H | Q |
| Library | R | S | S | Q | S | L | V | H | S | N | R | N | T | Y | L | H | Q |
| | A | A | D | D | E | I | L | | A | | | F | I | | A | A | |
| | E | P | | E | P | P | | | G | | | H | | | I | G | |
| | G | T | | | | V | | | I | | | M | | | V | T | |
| | Q | | | | | | | | L | | | Q | | | | V | |
| | S | | | | | | | | M | | | Y | | | | | |
| | T | | | | | | | | N | | | | | | | | |
| | Y | | | | | | | | P | | | | | | | | |
| | | | | | | | | | Q | | | | | | | | |
| | | | | | | | | | T | | | | | | | | |
| | | | | | | | | | V | | | | | | | | |

| Domain | CDR2 | | | | | | | FR3 | | CDR3 | | | | | | | | FR4 |
|---|---|---|---|---|---|---|---|---|---|---|---|---|---|---|---|---|---|---|
| Kabat | 5 | | | | | | | 7 | | | 8 | | | | | | | 10 |
| numbering | 0 | 1 | 2 | 3 | 4 | 5 | 6 | 4 | 7 | 9 | 0 | 1 | 2 | 3 | 4 | 5 | 6 | 7 | 7 |
| Before substitution | K | V | S | N | R | F | S | K | R | G | Q | G | T | Q | V | P | Y | T | K |
| Library | K | V | S | N | R | F | S | K | R | G | Q | G | T | Q | V | P | Y | T | K |
| | | G | A | P | P | A | G | T | S | A | E | | S | A | A | | F | | E |
| | | I | Q | W | | G | H | | | N | | | | S | D | | | | |
| | | | Y | | | H | I | | | T | | | | | N | | | | |
| | | | | | | K | L | | | | | | | | S | | | | |
| | | | | | | N | M | | | | | | | | T | | | | |
| | | | | | | P | N | | | | | | | | | | | | |
| | | | | | | Y | P | | | | | | | | | | | | |
| | | | | | | | Q | | | | | | | | | | | | |
| | | | | | | | T | | | | | | | | | | | | |
| | | | | | | | V | | | | | | | | | | | | |
| | | | | | | | Y | | | | | | | | | | | | |

TABLE 29

| Region | CDR1 | | | | | | | | | | | | | | | |
|---|---|---|---|---|---|---|---|---|---|---|---|---|---|---|---|---|
| Kabat | 2 | | | | | | | | | | | 3 | | | | |
| numbering | 4 | 5 | 6 | 7 | a | b | c | d | e | 8 | 9 | 0 | 1 | 2 | 3 | 4 |
| Original | R | S | S | Q | S | L | V | H | S | N | R | N | T | Y | L | H |
| Library | R | S | S | Q | S | L | V | H | S | N | R | N | T | Y | L | H |
| | A | A | D | | E | | L | | A | | | F | I | | | A |
| | E | T | | E | | | | | G | | | H | | | | G |

TABLE 29-continued

| | | | | | | | | | | | | | | | | |
|---|---|---|---|---|---|---|---|---|---|---|---|---|---|---|---|---|
| | G<br>Q<br>S<br>T<br>Y | | | | | | | | I<br>L<br>M<br>N<br>Q<br>T<br>V | | | M<br>Q<br>Y | | | | T<br>V |
| Region | CDR2 | | | | | | | CDR3 | | | | | | | | |
| Kabat<br>numbering | 5<br>0 | 1 | 2 | 3 | 4 | 5 | 6 | 9 | 9<br>0 | 1 | 2 | 3 | 4 | 5 | 6 | 7 |
| Original | K | V | S | N | R | F | S | G | Q | G | T | Q | V | P | Y | T |
| Library | K | V | S<br>A<br>Q<br>Y | N | R | F | S<br>G<br>H<br>I<br>L<br>M<br>N<br>Q<br>T<br>V<br>Y | G<br>A<br>N<br>T | Q<br>E | G | T<br>S | Q<br>A<br>S | V<br>A<br>D<br>N<br>S<br>T | P | Y<br>F | T |

[Reference Example 13] Experimental Cell Lines

The human GPC3 gene was integrated into the chromosome of the mouse colorectal cancer cell line CT-26 (ATCC No. CRL-2638) by a method well known to those skilled in the art to obtain the high expression CT26-GPC3 cell line. The expression level of human GPC3 ($2.3\times10^5$/cell) was determined using the QIFI kit (Dako) by the manufacturer's recommended method. To maintain the human GPC3 gene, these recombinant cell lines were cultured in ATCC-recommended media by adding Geneticin (GIBCO) at 200 micro g/ml for CT26-GPC3. After culturing, these cells were detached using 2.5 g/L trypsin-1 mM EDTA (nacalai tesque), and then used for each of the experiments. The transfectant cell line is herein referred to as SKpca60a.

The human CD137 gene was integrated into the chromosome of the Chinese Hamster Ovary cell line CHO-DG44 by a method well known to those skilled in the art to obtain the high expression CHO-hCD137 cell line. The expression level of human CD137 was determined by FACS analysis using the PE anti-human CD137 (4-1BB) Antibody (BioLegend, Cat. No. 309803) by the manufacturer's instructions.

NCI-H446 and Huh7 cell lines were maintained in RPM11640 (Gibco) and DMEM (low glucose) respectively. Both media were supplemented with 10% fetal bovine serum (Bovogen Biologicals), 100 units/mL of penicillin and 100 micro g/mL of streptomycin and cells were cultured at 370C with 5% CO2.

[Reference Example 14] Evaluation of Binding of Antibody to ECM (Extracellular Matrix)

The binding of each antibody to ECM (extracellular matrix) was evaluated by the following procedures with reference to WO2012093704 A1: ECM Phenol red free (BD Matrigel #356237) was diluted to 2 mg/mL with TBS and added dropwise at 5 micro L/well to the center of each well of a plate for ECL assay (L15XB-3. MSD K.K., high bind) cooled on ice. Then, the plate was capped with a plate seal and left standing overnight at 4 degrees C. The ECM-immobilized plate was brought to room temperature. An ECL blocking buffer (PBS supplemented with 0.5% BSA and 0.05% Tween 20) was added thereto at 150 micro L/well, and the plate was left standing at room temperature for 2 hours or longer or overnight at 4 degrees C. Next, each antibody sample was diluted to 9 micro g/mL with PBS-T (PBS supplemented with 0.05% Tween 20). A secondary antibody was diluted to 2 micro g/mL with ECLDB (PBS supplemented with 0.1% BSA and 0.01% Tween 20). 20 micro L of the antibody solution and 30 micro L of the secondary antibody solution were added to each well of a round-bottomed plate containing ECLDB dispensed at 10 micro L/well and stirred at room temperature for 1 hour while shielded from light. The ECL blocking buffer was removed by inverting the ECM plate containing the ECL blocking buffer. To this plate, a mixed solution of the aforementioned antibody and secondary antibody was added at 50 micro L/well. Then, the plate was left standing at room temperature for 1 hour while shielded from light. The sample was removed by inverting the plate, and READ buffer (MSD K.K.) was then added thereto at 150 micro L/well, followed by the detection of the luminescence signal of the sulfo-tag using Sector Imager 2400 (MSD K.K.).

[Reference Example 15] Assessment of Antibodies Having Cysteine Substitution at Various Positions in the Heavy Chain Reference Example 15.1 Assessment of Antibodies Having Cysteine Substitution at Various Positions in the Heavy Chain The heavy chain variable region and constant region of an anti-human IL6R neutralizing antibody, MRA (heavy chain: MRAH-G1T4 (SEQ ID NO: 201), light chain: MRAL-k0 (SEQ ID NO: 202)) were subjected to a study in which an arbitrary amino acid residue structurally exposed to the surface was substituted with cysteine.

Amino acid residues within the heavy chain variable region of MRA (MRAH, SEQ ID NO: 203) were substituted with cysteine to produce variants of the heavy chain variable region of MRA shown in Table 30. These variants of the heavy chain variable region of MRA were each linked with the heavy chain constant region of MRA (G1T4, SEQ ID NO: 204) to produce variants of the heavy chain of MRA, and expression vectors encoding the corresponding genes were produced by a method known to the person skilled in the art.

In addition, amino acid residues within the heavy chain constant region of MRA (G1T4, SEQ ID NO: 204) were substituted with cysteine to produce variants of the beavy chain constant region of MRA shown in Table 31. These variants of the heavy chain constant region of MRA were each linked with the heavy chain variable region of MRA (MRAH, SEQ ID NO: 203) to produce variants of the heavy chain of MRA, and expression vectors encoding the corresponding genes were produced by a method known to the person skilled in the art.

The MRA heavy chain variants produced above were combined with the MRA light chain. The resultant MRA variants shown in Table 32 were expressed by transient expression using FreeStyle293 cells (Invitrogen) or Expi293 cells (Life technologies) by a method known to the person skilled in the art, and purified with Protein A by a method known to the person skilled in the art.

Variants of MRA heavy chain variable region and position of cysteine substitution

| Variant of MRA heavy chain variable region | Position of cysteine substitution (Kabat numbering) | SEQ ID NO: |
|---|---|---|
| MRAH.Q5C | 5 | 207 |
| MRAH.E6C | 6 | 208 |
| MRAH.S7C | 7 | 209 |
| MRAH.G8C | 8 | 210 |
| MRAH.P9C | 9 | 211 |
| MRAH.G10C | 10 | 212 |
| MRAH.L11C | 11 | 213 |
| MRAH.V12C | 12 | 214 |
| MRAH.R13C | 13 | 215 |
| MRAH.P14C | 14 | 216 |
| MRAH.S15C | 15 | 217 |
| MRAH.Q16C | 16 | 218 |
| MRAH.T17C | 17 | 219 |
| MRAH.L18C | 18 | 220 |
| MRAH.S19C | 19 | 221 |
| MRAH.L20C | 20 | 222 |
| MRAH.T21C | 21 | 223 |
| MRAH.T23C | 23 | 224 |
| MRAH.S25C | 25 | 225 |
| MRAH.G26C | 26 | 226 |
| MRAH.S28C | 28 | 227 |
| MRAH.T30C | 30 | 228 |
| MRAH.R66C | 66 | 229 |
| MRAH.V67C | 67 | 230 |
| MRAH.T68C | 68 | 231 |
| MRAH.L70C | 70 | 232 |
| MRAH.D72C | 72 | 233 |
| MRAH.T73C | 73 | 234 |
| MRAH.S74C | 74 | 235 |
| MRAH.K75C | 75 | 236 |
| MRAH.N76C | 76 | 237 |
| MRAH.Q77C | 77 | 238 |
| MRAH.S79C | 79 | 239 |
| MRAH.L80C | 80 | 240 |
| MRAH.R81C | 81 | 241 |
| MRAH.L82C | 82 | 242 |
| MRAH.S82aC | 82a | 243 |
| MRAH.S82bC | 82b | 244 |
| MRAH.V82cC | 82 | 245 |
| MRAH.S112C | 112 | 246 |
| MRAH.S113C | 113 | 247 |
| MRAH.S31C | 31 | 248 |
| MRAH.W35C | 35 | 249 |
| MRAH.S35aC | 35a | 250 |

-continued

Variants of MRA heavy chain variable region and position of cysteine substitution

| Variant of MRA heavy chain variable region | Position of cysteine substitution (Kabat numbering) | SEQ ID NO: |
|---|---|---|
| MRAH.Y50C | 50 | 251 |
| MRAH.151C | 51 | 252 |
| MRAH.S52C | 52 | 253 |
| MRAH.S62C | 62 | 254 |
| MRAH.L63C | 63 | 255 |
| MRAH.K64C | 64 | 256 |
| MRAH.S65C | 65 | 257 |
| MRAH.D101C | 101 | 258 |
| MRAH.Y 102C | 102 | 259 |

TABLE 31

Variants of MRA heavy chain constant region and position of cysteine substitution

| Variant of MRA heavy chain constant region | Position of cysteine substitution (EU numbering) | SEQ ID NO: |
|---|---|---|
| G1T4.A118C | 118 | 260 |
| G1T4.S119C | 119 | 26 |
| G1T4.T120C | 120 | 262 |
| G1T4.K121C | 121 | 263 |
| G1T4.G122C | 122 | 264 |
| G1T4.P123C | 123 | 265 |
| G1T4.S124C | 124 | 266 |
| G1T4.V125C | 125 | 267 |
| G1T4.F126C | 126 | 268 |
| G1T4.P127C | 127 | 269 |
| G1T4.S131C | 131 | 270 |
| G1T4.S132C | 132 | 271 |
| G1T4.K133C | 133 | 272 |
| G1T4.S134C | 134 | 273 |
| G1T4.T135C | 135 | 274 |
| G1T4.S136C | 136 | 275 |
| G1T4.G137C | 137 | 276 |
| G1T4.G138C | 138 | 277 |
| G1T4.TI39C | 139 | 278 |
| G1T4.A140C | 140 | 279 |
| G1T4.A141C | 141 | 280 |
| G1T4.D148C | 148 | 281 |
| G1T4.Y149C | 149 | 282 |
| G1T4.F150C | 150 | 283 |
| G1T4.P151C | 151 | 284 |
| G1T4.E152C | 152 | 285 |
| G1T4.P153C | 153 | 286 |
| G1T4.V154C | 154 | 287 |
| G1T4.T155C | 155 | 288 |
| G1T4.V156C | 156 | 289 |
| G1T4.S157C | 157 | 290 |
| G1T4.W158C | 158 | 291 |
| G1T4.N159C | 159 | 292 |
| G1T4.S160C | 160 | 293 |
| G1T4.G161C | 161 | 294 |
| G1T4.A162C | 162 | 295 |
| G1T4.L163C | 163 | 296 |
| G1T4.T164C | 164 | 297 |
| G1T4.S165C | 165 | 298 |
| G1T4.G166C | 166 | 299 |
| G1T4.V167C | 167 | 300 |
| G1T4.V173C | 173 | 301 |
| G1T4.L174C | 174 | 302 |
| G1T4.Q175C | 175 | 303 |
| G1T4.S176C | 176 | 304 |
| G1T4.S177C | 177 | 305 |
| G1T4.G178C | 178 | 306 |
| G1T4.L179C | 179 | 307 |
| G1T4.Y180C | 180 | 308 |
| G1T4.V186C | 186 | 309 |
| G1T4.T187C | 187 | 310 |

TABLE 31-continued

| Variants of MRA heavy chain constant region and position of cysteine substitution | | |
|---|---|---|
| Variant of MRA heavy chain constant region | Position of cysteine substitution (EU numbering) | SEQ ID NO: |
| G1T4.V188C | 188 | 311 |
| G1T4.P189C | 189 | 312 |
| G1T4.S190C | 190 | 313 |
| G1T4.S191C | 191 | 314 |
| G1T4.S192C | 192 | 315 |
| G1T4.L193C | 193 | 316 |
| G1T4.G194C | 194 | 317 |
| G1T4.T195C | 195 | 318 |
| G1T4.Q196C | 196 | 319 |
| G1T4.T197C | 197 | 320 |
| G1T4.Y198C | 198 | 321 |
| G1T4.I199C | 199 | 322 |
| G1T4.N201C | 201 | 323 |
| G1T4.V202C | 202 | 324 |
| G1T4.N203C | 203 | 325 |
| G1T4.H204C | 204 | 326 |
| G1T4.K205C | 205 | 327 |
| G1T4.P206C | 206 | 328 |
| G1T4.S207C | 207 | 329 |
| G1T4.N208C | 208 | 330 |
| G1T4.T209C | 209 | 331 |
| G1T4.K210C | 210 | 332 |
| G1T4.V211C | 211 | 333 |
| G1T4.D212C | 212 | 334 |
| G1T4.K213C | 213 | 335 |
| G1T4.R214C | 214 | 336 |
| G1T4.V215C | 215 | 337 |
| G1T4.E216C | 216 | 338 |
| G1T4.P217C | 217 | 339 |
| G1T4.K218C | 218 | 340 |
| G1T4.S219C | 219 | 341 |

TABLE 32

| MRA variants | | | | |
|---|---|---|---|---|
| | SEQ ID NO: | | | |
| Antibody name | Heavy chain variable region | Heavy chain constant region | Light chain variable region | Light chain constant region |
| MRAH.Q5C-G1T4 | 207 | 204 | 205 | 206 |
| MRAH.E6C-G1T4 | 208 | 204 | 205 | 206 |
| MRAH.S7C-G1T4 | 209 | 204 | 205 | 206 |
| MRAH.G8C-G1T4 | 210 | 204 | 205 | 206 |
| MRAH.P9C-G1T4 | 211 | 204 | 205 | 206 |
| MRAH.G10C-G1T4 | 212 | 204 | 205 | 206 |
| MRAH.L11C-G1T4 | 213 | 204 | 205 | 206 |
| MRAH.V12C-G1T4 | 214 | 204 | 205 | 206 |
| MRAH.R13C-G1T4 | 215 | 204 | 205 | 206 |
| MRAH.P14C-G1T4 | 216 | 204 | 205 | 206 |
| MRAH.S15C-G1T4 | 217 | 204 | 205 | 206 |
| MRAH.Q16C-G1T4 | 218 | 204 | 205 | 206 |
| MRAH.T17C-G1T4 | 219 | 204 | 205 | 206 |
| MRAH.L18C-G1T4 | 220 | 204 | 205 | 206 |
| MRAH.S19C-G1T4 | 221 | 204 | 205 | 206 |
| MRAH.L20C-G1T4 | 222 | 204 | 205 | 206 |
| MRAH.T21C-G1T4 | 223 | 204 | 205 | 206 |
| MRAH.T23C-G1T4 | 224 | 204 | 205 | 206 |
| MRAH.S25C-G1T4 | 225 | 204 | 205 | 206 |
| MRAH.G26C-G1T4 | 226 | 204 | 205 | 206 |
| MRAH.S28C-G1T4 | 227 | 204 | 205 | 206 |
| MRAH.T30C-G1T4 | 228 | 204 | 205 | 206 |
| MRAH.R66C-G1T4 | 229 | 204 | 205 | 206 |
| MRAH.V67C-G1T4 | 230 | 204 | 205 | 206 |
| MRAH.T68C-G1T4 | 231 | 204 | 205 | 206 |
| MRAH.L70C-G1T4 | 232 | 204 | 205 | 206 |
| MRAH.D72C-G1T4 | 233 | 204 | 205 | 206 |

TABLE 32-continued

| MRA variants | | | | |
|---|---|---|---|---|
| | SEQ ID NO: | | | |
| Antibody name | Heavy chain variable region | Heavy chain constant region | Light chain variable region | Light chain constant region |
| MRAH.T73C-G1T4 | 234 | 204 | 205 | 206 |
| MRAH.S74C-G1T4 | 235 | 204 | 205 | 206 |
| MRAH.K75C-G1T4 | 236 | 204 | 205 | 206 |
| MRAH.N76C-G1T4 | 237 | 204 | 205 | 206 |
| MRAH.Q77C-G1T4 | 238 | 204 | 205 | 206 |
| MRAH.S79C-G1T4 | 239 | 204 | 205 | 206 |
| MRAH.L80C-G1T4 | 240 | 204 | 205 | 206 |
| MRAH.R81C-G1T4 | 241 | 204 | 205 | 206 |
| MRAH.L82C-G1T4 | 242 | 204 | 205 | 206 |
| MRAH.S82aC-G1T4 | 243 | 204 | 205 | 206 |
| MRAH.S82bC-G1T4 | 244 | 204 | 205 | 206 |
| MRAH.V82cC-G1T4 | 245 | 204 | 205 | 206 |
| MRAH.S112C-G1T4 | 246 | 204 | 205 | 206 |
| MRAH.S113C-G1T4 | 247 | 204 | 205 | 206 |
| MRAH.S31C-G1T4 | 248 | 204 | 205 | 206 |
| MRAH.W35C-G1T4 | 249 | 204 | 205 | 206 |
| MRAH.S35aC-G1T4 | 250 | 204 | 205 | 206 |
| MRAH.Y50C-G1T4 | 251 | 204 | 205 | 206 |
| MRAH.I51C-G1T4 | 252 | 204 | 205 | 206 |
| MRAH.S52C-G1T4 | 253 | 204 | 205 | 206 |
| MRAH.S62C-G1T4 | 254 | 204 | 205 | 206 |
| MRAH.L63C-G1T4 | 255 | 204 | 205 | 206 |
| MRAH.K64C-G1T4 | 256 | 204 | 205 | 206 |
| MRAH.S65C-G1T4 | 257 | 204 | 205 | 206 |
| MRAH.D101C-G1T4 | 258 | 204 | 205 | 206 |
| MRAH.Y102C-G1T4 | 259 | 204 | 205 | 206 |
| MRAH-G1T4.A118C | 203 | 260 | 205 | 206 |
| MRAH-G1T4.S119C | 203 | 261 | 205 | 206 |
| MRAH-G1T4.T120C | 203 | 262 | 205 | 206 |
| MRAH-G1T4.K121C | 203 | 263 | 205 | 206 |
| MRAH-G1T4.G122C | 203 | 264 | 205 | 206 |
| MRAH-G1T4.P123C | 203 | 265 | 205 | 206 |
| MRAH-G1T4.S124C | 203 | 266 | 205 | 206 |
| MRAH-G1T4.V125C | 203 | 267 | 205 | 206 |
| MRAH-G1T4.F126C | 203 | 268 | 205 | 206 |
| MRAH-G1T4.P127C | 203 | 269 | 205 | 206 |
| MRAH-G1T4.S131C | 203 | 270 | 205 | 206 |
| MRAH-G1T4.S132C | 203 | 271 | 205 | 206 |
| MRAH-G1T4.K133C | 203 | 272 | 205 | 206 |
| MRAH-G1T4.S134C | 203 | 273 | 205 | 206 |
| MRAH-G1T4.T135C | 203 | 274 | 205 | 206 |
| MRAH-G1T4.S136C | 203 | 275 | 205 | 206 |
| MRAH-G1T4.G137C | 203 | 276 | 205 | 206 |
| MRAH-G1T4.G138C | 203 | 277 | 205 | 206 |
| MRAH-G1T4.T139C | 203 | 278 | 205 | 206 |
| MRAH-G1T4.A140C | 203 | 279 | 205 | 206 |
| MRAH-G1T4.A141C | 203 | 280 | 205 | 206 |
| MRAH-G1T4.D148C | 203 | 281 | 205 | 206 |
| MRAH-G1T4.Y149C | 203 | 282 | 205 | 206 |
| MRAH-G1T4.F150C | 203 | 283 | 205 | 206 |
| MRAH-G1T4.P151C | 203 | 284 | 205 | 206 |
| MRAH-G1T4.E152C | 203 | 285 | 205 | 206 |
| MRAH-G1T4.P153C | 203 | 286 | 205 | 206 |
| MRAH-G1T4.V154C | 203 | 287 | 205 | 206 |
| MRAH-G1T4.T155C | 203 | 288 | 205 | 206 |
| MRAH-G1T4.V156C | 203 | 289 | 205 | 206 |
| MRAH-G1T4.S157C | 203 | 290 | 205 | 206 |
| MRAH-G1T4.W158C | 203 | 291 | 205 | 206 |
| MRAH-G1T4.N159C | 203 | 292 | 205 | 206 |
| MRAH-G1T4.S160C | 203 | 293 | 205 | 206 |
| MRAH-G1T4.G161C | 203 | 294 | 205 | 206 |
| MRAH-G1T4.A162C | 203 | 295 | 205 | 206 |
| MRAH-G1T4.L163C | 203 | 296 | 205 | 206 |
| MRAH-G1T4.T164C | 203 | 297 | 205 | 206 |
| MRAH-G1T4.S165C | 203 | 298 | 205 | 206 |
| MRAH-G1T4.G166C | 203 | 299 | 205 | 206 |
| MRAH-G1T4.V167C | 203 | 300 | 205 | 206 |
| MRAH-G1T4.V173C | 203 | 301 | 205 | 206 |
| MRAH-G1T4.L174C | 203 | 302 | 205 | 206 |
| MRAH-G1T4.Q175C | 203 | 303 | 205 | 206 |
| MRAH-G1T4.S176C | 203 | 304 | 205 | 206 |

TABLE 32-continued

MRA variants

| Antibody name | SEQ ID NO: Heavy chain variable region | Heavy chain constant region | Light chain variable region | Light chain constant region |
|---|---|---|---|---|
| MRAH-G1T4.S177C | 203 | 305 | 205 | 206 |
| MRAH-G1T4.G178C | 203 | 306 | 205 | 206 |
| MRAH-G1T4.L179C | 203 | 307 | 205 | 206 |
| MRAH-G1T4.Y180C | 203 | 308 | 205 | 206 |
| MRAH-G1T4.V186C | 203 | 309 | 205 | 206 |
| MRAH-G1T4.T187C | 203 | 310 | 205 | 206 |
| MRAH-G1T4.V188C | 203 | 311 | 205 | 206 |
| MRAH-G1T4.P189C | 203 | 312 | 205 | 206 |
| MRAH-G1T4.S190C | 203 | 313 | 205 | 206 |
| MRAH-G1T4.S191C | 203 | 314 | 205 | 206 |
| MRAH-G1T4.S192C | 203 | 315 | 205 | 206 |
| MRAH-G1T4.L193C | 203 | 316 | 205 | 206 |
| MRAH-G1T4.G194C | 203 | 317 | 205 | 206 |
| MRAH-G1T4.T195C | 203 | 318 | 205 | 206 |
| MRAH-G1T4.Q196C | 203 | 319 | 205 | 206 |
| MRAH-G1T4.T197C | 203 | 320 | 205 | 206 |
| MRAH-G1T4.Y198C | 203 | 321 | 205 | 206 |
| MRAH-G1T4.I199C | 203 | 322 | 205 | 206 |
| MRAH-G1T4.N201C | 203 | 323 | 205 | 206 |
| MRAH-G1T4.V202C | 203 | 324 | 205 | 206 |
| MRAH-G1T4.N203C | 203 | 325 | 205 | 206 |
| MRAH-G1T4.H204C | 203 | 326 | 205 | 206 |
| MRAH-G1T4.K205C | 203 | 327 | 205 | 206 |
| MRAH-G1T4.P206C | 203 | 328 | 205 | 206 |
| MRAH-G1T4.S207C | 203 | 329 | 205 | 206 |
| MRAH-G1T4.N208C | 203 | 330 | 205 | 206 |
| MRAH-G1T4.T209C | 203 | 331 | 205 | 206 |
| MRAH-G1T4.K210C | 203 | 332 | 205 | 206 |
| MRAH-G1T4.V211C | 203 | 333 | 205 | 206 |
| MRAH-G1T4.D212C | 203 | 334 | 205 | 206 |
| MRAH-G1T4.K213C | 203 | 335 | 205 | 206 |
| MRAH-G1T4.R214C | 203 | 336 | 205 | 206 |
| MRAH-G1T4.V215C | 203 | 337 | 205 | 206 |
| MRAH-G1T4.E216C | 203 | 338 | 205 | 206 |
| MRAH-G1T4.P217C | 203 | 339 | 205 | 206 |
| MRAH-G1T4.K218C | 203 | 340 | 205 | 206 |
| MRAH-G1T4.S219C | 203 | 341 | 205 | 206 |

Reference Example 15.2 Assessment of Protease-Mediated Fab Fragmentation of Antibodies Having Cysteine Substitution at Various Positions in the Heavy Chain Using a protease that cleaves the heavy chain hinge region of antibody to cause Fab fragmentation, the MRA variants produced in Reference Example 15.1 were examined for whether they acquired protease resistance so that their fragmentation would be inhibited. The protease used was Lys-C(Endoproteinase Lys-C Sequencing Grade) (SIGMA: 11047825001). Reaction was performed under the conditions of 2 ng/micro L protease, 100 micro g/mL, antibody, 80% 25 mM Tris-HCl pH 8.0, 20% PBS, and 35 degrees C., for two hours, or under the conditions of 2 ng/micro L protease, 20 micro g/mL antibody, 80% 25 mM Tris-HCl pH 8.0, 20% PBS, and 35 degrees C., for one hour. The sample was then subjected to non-reducing capillary electrophoresis. Wes (Protein Simple) was used for capillary electrophoresis, and an HRP-labeled anti-kappa chain antibody (abcam: ab46527) was used for detection.

The results are shown in FIGS. 27 to 34. Lys-C treatment of MRA caused cleavage of the heavy chain hinge region, resulting in disappearance of the band of IgG at around 150 kDa and appearance of the band of Fab at around 50 kDa. For the MRA variants produced in Reference Example 15.1, some showed the band of Fab dimer appearing at around 96 kDa and some showed the band of undigested IgG detected at around 150 kDa after the protease treatment. The area of each band obtained after the protease treatment was outputted using software dedicated for Wes (Compass for SW; Protein Simple) to calculate the percentage of the band areas of undigested IgG. Fab dimer, etc. The calculated percentage of each band is shown in Table 33.

TABLE 33

| Antibody name | IgG (%) | Fab-Fab (%) | Fab (%) | Heavy chain variable region SEQ ID NO: | Light chain SEQ ID NO: |
|---|---|---|---|---|---|
| MRAH.Q5C-G1T4 | 0.2 | 1.5 | 97.6 | 207 | 202 |
| MRAH.E6C-G1T4 | 0 | 0.3 | 80.7 | 208 | 202 |
| MRAH.S7C-G1T4 | 0.4 | 1.9 | 96.9 | 209 | 202 |
| MRAH.G8C-G1T4 | 16.6 | 1.1 | 76.7 | 210 | 202 |
| MRAH.P9C-G1T4 | 0.2 | 1.5 | 97.2 | 211 | 202 |
| MRAH.G10C-G1T4 | 0.6 | 1.9 | 96.9 | 212 | 202 |
| MRAH.L11C-G1T4 | 0 | 1.2 | 98.3 | 213 | 202 |
| MRAH.VI2C-G1T4 | 0.2 | 1 | 97.6 | 214 | 202 |
| MRAH.R13C-G1T4 | 0.6 | 1.9 | 96.6 | 215 | 202 |
| MRAH.P14C-G1T4 | 0.3 | 1.7 | 97.7 | 216 | 202 |
| MRAH.S15C-G1T4 | 0.9 | 1.3 | 81.4 | 217 | 202 |
| MRAH.Q16C-G1T4 | 92.5 | 0 | 2 | 218 | 202 |
| MRAH.T17C-G1T4 | 0.4 | 1.4 | 97.8 | 219 | 202 |
| MRAH.L18C-G1T4 | 0.3 | 0.6 | 96.1 | 220 | 202 |
| MRAH.S19C-G1T4 | 0.3 | 1.2 | 98.1 | 221 | 202 |
| MRAH.L20C-G1T4 | 1 | 0.3 | 93.3 | 222 | 202 |
| MRAH.T21C-G1T4 | 0.5 | 1 | 98.3 | 223 | 202 |
| MRAH.T23C-G1T4 | no data | no data | no data | 224 | 202 |
| MRAH.S25C-G1T4 | 0.3 | 2.8 | 87 | 225 | 202 |
| MRAH.G26C-G1T4 | 0.4 | 1.7 | 85.5 | 226 | 202 |
| MRAH.S28C-G1T4 | 98.6 | 0 | 0.2 | 227 | 202 |
| MRAH.T30C-G1T4 | 0.5 | 0.7 | 97.8 | 228 | 202 |
| MRAH.R66C-G1T4 | 0.2 | 1.2 | 97.9 | 229 | 202 |
| MRAH.V67C-G1T4 | 0.3 | 0.4 | 97.8 | 230 | 202 |
| MRAH.T68C-G1T4 | 0.2 | 1.4 | 97.7 | 231 | 202 |
| MRAH.L70C-G1T4 | 0.2 | 0.9 | 98 | 232 | 202 |
| MRAH.D72C-G1T4 | 0.3 | 0.8 | 97.6 | 233 | 202 |
| MRAH.T73C-G1T4 | 0.5 | 0.9 | 97.7 | 234 | 202 |
| MRAH.S74C-G1T4 | 97.1 | 0 | 0.3 | 235 | 202 |
| MRAH.K75C-G1T4 | 0.1 | 1.5 | 97 | 236 | 202 |
| MRAH.N76C-G1T4 | 0.4 | 0.4 | 93.1 | 237 | 202 |
| MRAH.Q77C-G1T4 | 0.1 | 0.2 | 99.6 | 238 | 202 |
| MRAH.S79C-G1T4 | 0.1 | 1.6 | 96.7 | 239 | 202 |
| MRAH.L80C-G1T4 | 0.2 | 0 | 96.5 | 240 | 202 |
| MRAH.R81C-G1T4 | 0 | 1.4 | 98 | 241 | 202 |
| MRAH.L82C-G1T4 | 0 | 0 | 96.8 | 242 | 202 |
| MRAH.S82aC-G1T4 | 0.6 | 1 | 96.7 | 243 | 202 |
| MRAH.S82bC-G1T4 | 97.5 | 0 | 0.3 | 244 | 202 |
| MRAH.V82cC-G1T4 | 0.1 | 0.3 | 95.6 | 245 | 202 |
| MRAH.S112C-G1T4 | 0.1 | 1.1 | 97.6 | 246 | 202 |
| MRAH.S113C-G1T4 | 0.1 | 2.8 | 95.9 | 247 | 202 |
| MRAH.S31C-G1T4 | 0.5 | 2 | 75.7 | 248 | 202 |
| MRAH.W35C-G1T4 | 0.1 | 0.3 | 91.1 | 249 | 202 |
| MRAH.S35aC-G1T4 | 0 | 0.6 | 90.7 | 250 | 202 |
| MRAH.Y50C-G1T4 | 0.2 | 1.5 | 95.8 | 251 | 202 |
| MRAH.I51C-G1T4 | 0.2 | 0.8 | 94.4 | 252 | 202 |
| MRAH.S52C-G1T4 | 0.3 | 1.7 | 96.4 | 253 | 202 |
| MRAH.S62C-G1T4 | 0.2 | 1.1 | 97.6 | 254 | 202 |
| MRAH.L63C-G1T4 | 0.4 | 1.4 | 94.2 | 255 | 202 |
| MRAH.K64C-G1T4 | 0 | 1.6 | 91.7 | 256 | 202 |
| MRAH.S65C-G1T4 | 0.3 | 1.7 | 95.6 | 257 | 202 |
| MRAH.D101C-G1T4 | 0 | 1.2 | 97 | 258 | 202 |
| MRAH.Y102C-G1T4 | 0.2 | 1.3 | 96.8 | 259 | 202 |
| MRAH-G1T4.A118C | 1.2 | 1 | 89 | 260 | 202 |
| MRAH-G1T4.S119C | 2.3 | 14 | 77.7 | 261 | 202 |
| MRAH-G1T4.T120C | 0 | 0.1 | 0.1 | 262 | 202 |
| MRAH-G1T4.K121C | 2.4 | 1.1 | 82.2 | 263 | 202 |
| MRAH-G1T4.G122C | 8 | 1.4 | 79.8 | 264 | 202 |
| MRAH-G1T4.P123C | 7.1 | 0 | 45.7 | 265 | 202 |
| MRAH-G1T4.S124C | 0.8 | 1.7 | 94.5 | 266 | 202 |
| MRAH-G1T4.V125C | 2.3 | 0 | 62 | 267 | 202 |
| MRAH-G1T4.F126C | 2.1 | 1 | 85.5 | 268 | 202 |

TABLE 33-continued

| Antibody name | IgG (%) | Fab-Fab (%) | Fab (%) | Heavy chain variable region SEQ ID NO: | Light chain SEQ ID NO: |
|---|---|---|---|---|---|
| MRAH-G1T4.P127C | 2.9 | 1.4 | 77.4 | 269 | 202 |
| MRAH-G1T4.S131C | 68.4 | 0 | 0 | 270 | 202 |
| MRAH-G1T4.S132C | 13.9 | 0.8 | 54.6 | 271 | 202 |
| MRAH-G1T4.K133C | 66.8 | 0 | 0 | 272 | 202 |
| MRAH-G1T4.S134C | 63.5 | 0 | 21.9 | 273 | 202 |
| MRAH-G1T4.T135C | 44.7 | 13.2 | 23.6 | 274 | 202 |
| MRAH-G1T4.S136C | 22.9 | 27.3 | 35.1 | 275 | 202 |
| MRAH-G1T4.G137C | 8.4 | 18.1 | 62.1 | 276 | 202 |
| MRAH-G1T4.G138C | no data | no data | no data | 277 | 202 |
| MRAH-G1T4.T139C | 7.4 | 1.4 | 82.1 | 278 | 202 |
| MRAH-G1T4.A140C | 20.2 | 0 | 47.2 | 279 | 202 |
| MRAH-G1T4.A141C | 0.3 | 0 | 31.9 | 280 | 202 |
| MRAH-G1T4.D148C | 21 | 0 | 64.8 | 281 | 202 |
| MRAH-G1T4.Y149C | 0.5 | 0 | 58.1 | 282 | 202 |
| MRAH-G1T4.F150C | 79.2 | 0 | 0.4 | 283 | 202 |
| MRAH-G1T4.P151C | 2 | 0 | 56.1 | 284 | 202 |
| MRAH-G1T4.E152C | 0.9 | 0.3 | 84.8 | 285 | 202 |
| MRAH-G1T4.P153C | 4.4 | 0.8 | 86.6 | 286 | 202 |
| MRAH-G1T4.V154C | 4 | 0 | 45.7 | 287 | 202 |
| MRAH-G1T4.T155C | 20.2 | 1.4 | 67.6 | 288 | 202 |
| MRAH-G1T4.V156C | 7 | 0 | 39.2 | 289 | 202 |
| MRAH-G1T4.S157C | 13.5 | 3.2 | 75.9 | 290 | 202 |
| MRAH-G1T4.W158C | 4.2 | 0 | 66.1 | 291 | 202 |
| MRAH-G1T4.N159C | 13.9 | 1.9 | 76.1 | 292 | 202 |
| MRAH-G1T4.S160C | 7.7 | 20.9 | 66.2 | 293 | 202 |
| MRAH-G1T4.G161C | 14.1 | 12 | 68.6 | 294 | 202 |
| MRAH-G1T4.A162C | 9.6 | 17.9 | 65.8 | 295 | 202 |
| MRAH-G1T4.L163C | 10.2 | 6.1 | 75.9 | 296 | 202 |
| MRAH-G1T4.T164C | 3.8 | 3.2 | 88.7 | 297 | 202 |
| MRAH-G1T4.S165C | 7.8 | 4.1 | 81.5 | 298 | 202 |
| MRAH-G1T4.G166C | 4.5 | 2.2 | 89.4 | 299 | 202 |
| MRAH-G1T4.V167C | 5.5 | 2.5 | 81.2 | 300 | 202 |
| MRAH-G1T4.V173C | 2.1 | 1.6 | 92.2 | 301 | 202 |
| MRAH-G1T4.L174C | 19.8 | 0 | 67.1 | 302 | 202 |
| MRAH-G1T4.Q175C | 4.4 | 1.1 | 86.6 | 303 | 202 |
| MRAH-G1T4.S176C | 2.3 | 7.7 | 85.5 | 304 | 202 |
| MRAH-G1T4.S177C | 7.1 | 12.4 | 71.6 | 305 | 202 |
| MRAH-G1T4.G178C | 6.2 | 2.4 | 85.5 | 306 | 202 |
| MRAH-G1T4.L179C | 0.2 | 0 | 0 | 307 | 202 |
| MRAH-G1T4.Y180C | 0 | 0 | 72.7 | 308 | 202 |
| MRAH-G1T4.V186C | 0 | 0 | 73.3 | 309 | 202 |
| MRAH-G1T4.T187C | 0.8 | 2.5 | 90.3 | 310 | 202 |
| MRAH-G1T4.V188C | 0.3 | 4 | 82.7 | 311 | 202 |
| MRAH-G1T4.P189C | 0.9 | 4.7 | 89.6 | 312 | 202 |
| MRAH-G1T4.S190C | 10.9 | 0 | 74.4 | 313 | 202 |
| MRAH-G1T4.S19IC | 2.3 | 46.4 | 45.1 | 314 | 202 |
| MRAH-G1T4.S192C | 1.3 | 11 | 83 | 315 | 202 |
| MRAH-G1T4.L193C | 3.6 | 0 | 70.5 | 316 | 202 |
| MRAH-G1T4.G194C | 13.8 | 0 | 0 | 317 | 202 |
| MRAH-G1T4.T195C | 29.6 | 0 | 57.3 | 318 | 202 |
| MRAH-G1T4.Q196C | 1.5 | 0 | 92.6 | 319 | 202 |
| MRAH-G1T4.T197C | 81.5 | 0 | 4.5 | 320 | 202 |
| MRAH-G1T4.Y198C | 0.1 | 0.3 | 17.1 | 321 | 202 |
| MRAH-G1T4.1199C | 1 | 1.7 | 91.6 | 322 | 202 |
| MRAH-G1T4.N201C | 0.7 | 4 | 90.3 | 323 | 202 |
| MRAH-G1T4.V202C | 0 | 0.1 | 6.6 | 324 | 202 |
| MRAH-G1T4.N203C | 0.6 | 2.4 | 89.8 | 325 | 202 |
| MRAH-G1T4.H204C | 0.4 | 2.2 | 77.7 | 326 | 202 |
| MRAH-G1T4.K205C | 0.2 | 2.3 | 85.5 | 327 | 202 |
| MRAH-G1T4.P206C | 0.4 | 2.1 | 86.9 | 328 | 202 |
| MRAH-G1T4.S207C | no data | no data | no data | 329 | 202 |
| MRAH-G1T4.N208C | 0.4 | 0 | 86.2 | 330 | 202 |
| MRAH-G1T4.T209C | 0.7 | 0 | 83.1 | 331 | 202 |
| MRAH-G1T4.K210C | 0.6 | 0 | 81.7 | 332 | 202 |
| MRAH-G1T4.V211C | 0.3 | 1 | 67.6 | 333 | 202 |
| MRAH-G1T4.D212C | 1.1 | 1.8 | 80.9 | 334 | 202 |
| MRAH-G1T4.K213C | 6.5 | 0 | 41.9 | 335 | 202 |
| MRAH-G1T4.R214C | 18.6 | 0 | 42.7 | 336 | 202 |
| MRAH-G1T4.V215C | 0 | 0 | 11.8 | 337 | 202 |
| MRAH-G1T4.E216C | 7.4 | 0 | 64.8 | 338 | 202 |
| MRAH-G1T4.P217C | 4.5 | 0.2 | 43.3 | 339 | 202 |
| MRAH-G1T4.K218C | 30.8 | 0 | 29.5 | 340 | 202 |
| MRAH-G1T4.S219C | 46.9 | 0.1 | 18 | 341 | 202 |

From this result, it was found that cysteine substitution in the heavy chain variable region or heavy chain constant region improved the protease resistance of the heavy chain hinge region in the MRA variants shown in Table 34. Alternatively, the result suggested that a Fab dimer was formed by a covalent bond between the Fab-Fab.

TABLE 34

| MRA variants | | | | |
|---|---|---|---|---|
| | SEQ ID NO: | | | |
| Antibody name | Heavy chain variable region | Heavy chain constant region | Light chain variable region | Light chain constant region |
| MRAH.G8C-G1T4 | 210 | 204 | 205 | 206 |
| MRAH.Q16C-G1T4 | 218 | 204 | 205 | 206 |
| MRAH.S28C-G1T4 | 227 | 204 | 205 | 206 |
| MRAH.S74C-G1T4 | 235 | 204 | 205 | 206 |
| MRAH.S82bC-G1T4 | 244 | 204 | 205 | 206 |
| MRAH-G1T4.S119C | 203 | 261 | 205 | 206 |
| MRAH-G1T4.G122C | 203 | 264 | 205 | 206 |
| MRAH-G1T4.P123C | 203 | 265 | 205 | 206 |
| MRAH-G1T4.S131C | 203 | 270 | 205 | 206 |
| MRAH-G1T4.S132C | 203 | 271 | 205 | 206 |
| MRAH-G1T4.K133C | 203 | 272 | 205 | 206 |
| MRAH-G1T4.S134C | 203 | 273 | 205 | 206 |
| MRAH-G1T4.T135C | 203 | 274 | 205 | 206 |
| MRAH-G1T4.S136C | 203 | 275 | 205 | 206 |
| MRAH-G1T4.G137C | 203 | 276 | 205 | 206 |
| MRAH-G1T4.T139C | 203 | 278 | 205 | 206 |
| MRAH-G1T4.A140C | 203 | 279 | 205 | 206 |
| MRAH-G1T4.D148C | 203 | 281 | 205 | 206 |
| MRAH-G1T4.F150C | 203 | 283 | 205 | 206 |
| MRAH-G1T4.T155C | 203 | 288 | 205 | 206 |
| MRAH-G1T4.V156C | 203 | 289 | 205 | 206 |
| MRAH-G1T4.S157C | 203 | 290 | 205 | 206 |
| MRAH-G1T4.N159C | 203 | 292 | 205 | 206 |
| MRAH-G1T4.S160C | 203 | 293 | 205 | 206 |
| MRAH-G1T4.G161C | 203 | 294 | 205 | 206 |
| MRAH-G1T4.A162C | 203 | 295 | 205 | 206 |
| MRAH-G1T4.L163C | 203 | 296 | 205 | 206 |
| MRAH-G1T4.S165C | 203 | 298 | 205 | 206 |
| MRAH-G1T4.V167C | 203 | 300 | 205 | 206 |
| MRAH-G1T4.L174C | 203 | 302 | 205 | 206 |
| MRAH-G1T4.S176C | 203 | 304 | 205 | 206 |
| MRAH-G1T4.S177C | 203 | 305 | 205 | 206 |
| MRAH-G1T4.G178C | 203 | 306 | 205 | 206 |
| MRAH-G1T4.S190C | 203 | 313 | 205 | 206 |
| MRAH-G1T4.S191C | 203 | 314 | 205 | 206 |
| MRAH-G1T4.S192C | 203 | 315 | 205 | 206 |
| MRAH-G1T4.G194C | 203 | 317 | 205 | 206 |
| MRAH-G1T4.T195C | 203 | 318 | 205 | 206 |
| MRAH-G1T4.T197C | 203 | 320 | 205 | 206 |
| MRAH-G1T4.K213C | 203 | 335 | 205 | 206 |
| MRAH-G1T4.R214C | 203 | 336 | 205 | 206 |
| MRAH-G1T4.E216C | 203 | 338 | 205 | 206 |
| MRAH-G1T4.K218C | 203 | 340 | 205 | 206 |
| MRAH-G1T4.S219C | 203 | 341 | 205 | 206 |

[Reference Example 16] Assessment of Antibodies Having Cysteine Substitution at Various Positions in the Light Chain

Example 16.1 Assessment of Antibodies Having Cysteine Substitution at Various Positions in the Light Chain The light chain variable region and constant region of an anti-human IL6R neutralizing antibody, MRA (heavy chain: MRAH-G1T4 (SEQ ID NO: 201), light chain: MRAL-k0 (SEQ ID NO: 202)) were subjected to a study in which an arbitrary amino acid residue structurally exposed to the surface was substituted with cysteine.

Amino acid residues within the light chain variable region of MRA (MRAL, SEQ ID NO: 205) were substituted with cysteine to produce variants of the light chain variable region of MRA shown in Table 35. These variants of the light chain variable region of MRA were each linked with the light chain constant region of MRA (k0, SEQ ID NO: 206) to produce variants of the light chain of MRA, and expression vectors encoding the corresponding genes were produced by a method known to the person skilled in the art. In addition, amino acid residues within the light chain constant region of MRA (k0, SEQ ID NO: 206) were substituted with cysteine to produce variants of the light chain constant region of MRA shown in Table 36. These variants of the light chain constant region of MRA were each linked with the light chain variable region of MRA (MRAL, SEQ ID NO: 205) to produce variants of the light chain of MRA, and expression vectors encoding the corresponding genes were produced by a method known to the person skilled in the art.

The MRA light chain variants produced above were combined with the MRA heavy chain. The resultant MRA variants shown in Table 37 were expressed by transient expression using FreeStyle293 cells (Invitrogen) or Expi293 cells (Life technologies) by a method known to the person skilled in the art, and purified with Protein A by a method known to the person skilled in the art.

TABLE 35

Variants of MRA light chain variable region and position of cysteine substitution

| Variant of MRA light chain variable region | Position of cysteine substitution (Kabat numbering) | SEQ ID NO: |
|---|---|---|
| MRAL.T5C | 5 | 342 |
| MRAL.Q6C | 6 | 343 |
| MRAL.S7C | 7 | 344 |
| MRAL.P8C | 8 | 345 |
| MRAL.S9C | 9 | 346 |
| MRAL.S10C | 10 | 347 |
| MRAL.L11C | 11 | 348 |
| MRAL.S12C | 12 | 349 |
| MRAL.A13C | 13 | 350 |
| MRAL.S14C | 14 | 351 |
| MRAL.V15C | 15 | 352 |
| MRAL.G16C | 16 | 353 |
| MRAL.D17C | 17 | 354 |
| MRAL.R18C | 18 | 355 |
| MRAL.V19C | 19 | 356 |
| MRAL.T20C | 20 | 357 |
| MRAL.I21C | 21 | 358 |
| MRAL.T22C | 22 | 359 |
| MRAL.G57C | 57 | 360 |
| MRAL.V58C | 58 | 361 |
| MRAL.P59C | 59 | 362 |
| MRAL.S60C | 60 | 363 |

TABLE 35-continued

Variants of MRA light chain variable region and position of cysteine substitution

| Variant of MRA light chain variable region | Position of cysteine substitution (Kabat numbering) | SEQ ID NO: |
|---|---|---|
| MRAL.R61C | 61 | 364 |
| MRAL.F62C | 62 | 365 |
| MRAL.S63C | 63 | 366 |
| MRAL.S65C | 65 | 367 |
| MRAL.S67C | 67 | 368 |
| MRAL.G68C | 68 | 369 |
| MRAL.T69C | 69 | 370 |
| MRAL.D70C | 70 | 371 |
| MRAL.T72C | 72 | 372 |
| MRAL.F73C | 73 | 373 |
| MRAL.T74C | 74 | 374 |
| MRAL.I75C | 75 | 375 |
| MRAL.S76C | 76 | 376 |
| MRAL.S77C | 77 | 377 |
| MRAL.L78C | 78 | 378 |
| MRAL.Q79C | 79 | 379 |
| MRAL.F98C | 98 | 380 |
| MRAL.G99C | 99 | 381 |
| MRAL.Q100C | 100 | 382 |
| MRAL.G101C | 101 | 383 |
| MRAL.T102C | 102 | 384 |
| MRAL.K103C | 103 | 385 |
| MRAL.V104C | 104 | 386 |
| MRAL.E105C | 105 | 387 |
| MRAL.I106C | 106 | 388 |
| MRAL.K107C | 107 | 389 |
| MRAL.A25C | 25 | 390 |
| MRAL.S26C | 26 | 391 |
| MRAL.Q27C | 27 | 392 |
| MRAL.Y32C | 32 | 393 |
| MRAL.L33C | 33 | 394 |
| MRAL.N34C | 34 | 395 |
| MRAL.Y50C | 50 | 396 |
| MRAL.T51C | 51 | 397 |
| MRAL.H55C | 55 | 398 |
| MRAL.S56C | 56 | 399 |
| MRAL.Y96C | 96 | 400 |
| MRAL.T97C | 97 | 401 |

TABLE 36

Variants of MRA light chain constant region and position of cysteine substitution

| Variant of MRA light chain constant region | Position of cysteine substitution (EU numbering) | SEQ ID NO: |
|---|---|---|
| k0.R108C | 108 | 402 |
| k0.T109C | 109 | 403 |
| k0.V110C | 110 | 404 |
| k0.A111C | 111 | 405 |
| k0.A112C | 112 | 406 |
| k0.P113C | 113 | 407 |
| k0.S114C | 114 | 408 |
| k0.V115C | 115 | 409 |
| k0.F116C | 116 | 410 |
| k0.P120C | 120 | 411 |
| k0.S121C | 121 | 412 |
| k0.D122C | 122 | 413 |
| k0.E123C | 123 | 414 |
| k0.Q124C | 124 | 415 |
| k0.L125C | 125 | 416 |
| k0.K126C | 126 | 417 |
| k0.S127C | 127 | 418 |
| k0.G128C | 128 | 419 |
| k0.T129C | 129 | 420 |
| k0.A130C | 130 | 421 |
| k0.S131C | 131 | 422 |
| k0.L136C | 136 | 423 |

TABLE 36-continued

| Variants of MRA light chain constant region and position of cysteine substitution | | |
|---|---|---|
| Variant of MRA light chain constant region | Position of cysteine substitution (EU numbering) | SEQ ID NO: |
| k0.N137C | 137 | 424 |
| k0.N138C | 138 | 425 |
| k0.F139C | 139 | 426 |
| k0.Y140C | 140 | 427 |
| k0.P141C | 141 | 428 |
| k0.R142C | 142 | 429 |
| k0.E143C | 143 | 430 |
| k0.A144C | 144 | 431 |
| k0.K145C | 145 | 432 |
| k0.V146C | 146 | 433 |
| k0.Q147C | 147 | 434 |
| k0.W148C | 148 | 435 |
| k0.K149C | 149 | 436 |
| k0.V150C | 150 | 437 |
| k0.D151C | 151 | 438 |
| k0.N152C | 152 | 439 |
| k0.A153C | 153 | 440 |
| k0.L154C | 154 | 441 |
| k0.Q155C | 155 | 442 |
| k0.S156C | 156 | 443 |
| k0.G157C | 157 | 444 |
| k0.N158C | 158 | 445 |
| k0.S159C | 159 | 446 |
| k0.Q160C | 160 | 447 |
| k0.E161C | 161 | 448 |
| k0.S162C | 162 | 449 |
| k0.V163C | 163 | 450 |
| k0.T164C | 164 | 451 |
| k0.E165C | 165 | 452 |
| k0.Q166C | 166 | 453 |
| k0.D167C | 167 | 454 |
| k0.S168C | 168 | 455 |
| k0.K169C | 169 | 456 |
| k0.D170C | 170 | 457 |
| k0.S171C | 171 | 458 |
| k0.T172C | 172 | 459 |
| k0.Y173C | 173 | 460 |
| k0.S174C | 174 | 46 |
| k0.L175C | 175 | 462 |
| k0.T180C | 180 | 463 |
| k0.L181C | 181 | 464 |
| k0.S182C | 182 | 465 |
| k0.K183C | 183 | 466 |
| k0.A184C | 184 | 467 |
| k0.D185C | 185 | 468 |
| k0.Y186C | 186 | 469 |
| k0.E187C | 187 | 470 |
| k0.K188C | 188 | 471 |
| k0.H189C | 189 | 472 |
| k0.K190C | 190 | 473 |
| k0.V191C | 191 | 474 |
| k0.Y192C | 192 | 475 |
| k0.A193C | 193 | 476 |
| k0.E195C | 195 | 477 |
| k0.V196C | 196 | 478 |
| k0.T197C | 197 | 479 |
| k0.H198C | 198 | 480 |
| k0.Q199C | 199 | 481 |
| k0.G200C | 200 | 482 |
| k0.L201C | 201 | 483 |
| k0.S202C | 202 | 484 |
| k0.S203C | 203 | 485 |
| k0.P204C | 204 | 486 |
| k0.V205C | 205 | 487 |
| k0.T206C | 206 | 488 |
| k0.K207C | 207 | 489 |
| k0.S208C | 208 | 490 |
| k0.F209C | 209 | 491 |
| k0.N210C | 210 | 492 |
| k0.R211C | 211 | 493 |
| k0.G212C | 212 | 494 |
| k0.E213C | 213 | 495 |

TABLE 37

| MRA variants | | | | |
|---|---|---|---|---|
| | SEQ ID NO: | | | |
| Antibody name | Heavy chain variable region | Heavy chain constant region | Light chain variable region | Light chain constant region |
| MRAL.T5C-k0 | 203 | 204 | 342 | 206 |
| MRAL.Q6C-k0 | 203 | 204 | 343 | 206 |
| MRAL.S7C-k0 | 203 | 204 | 344 | 206 |
| MRAL.P8C-k0 | 203 | 204 | 345 | 206 |
| MRAL.S9C-k0 | 203 | 204 | 346 | 206 |
| MRAL.S10C-k0 | 203 | 204 | 347 | 206 |
| MRAL.L11C-k0 | 203 | 204 | 348 | 206 |
| MRAL.S12C-k0 | 203 | 204 | 349 | 206 |
| MRAL.A13C-k0 | 203 | 204 | 350 | 206 |
| MRAL.S14C-k0 | 203 | 204 | 351 | 206 |
| MRAL.V15C-k0 | 203 | 204 | 352 | 206 |
| MRAL.G16C-k0 | 203 | 204 | 353 | 206 |
| MRAL.D17C-k0 | 203 | 204 | 354 | 206 |
| MRAL.R18C-k0 | 203 | 204 | 355 | 206 |
| MRAL.V19C-k0 | 203 | 204 | 356 | 206 |
| MRAL.T20C-k0 | 203 | 204 | 357 | 206 |
| MRAL.I21C-k0 | 203 | 204 | 358 | 206 |
| MRAL.T22C-k0 | 203 | 204 | 359 | 206 |
| MRAL.G57C-k0 | 203 | 204 | 360 | 206 |
| MRAL.V58C-k0 | 203 | 204 | 361 | 206 |
| MRAL.P59C-k0 | 203 | 204 | 362 | 206 |
| MRAL.S60C-k0 | 203 | 204 | 363 | 206 |
| MRAL.R61C-k0 | 203 | 204 | 364 | 206 |
| MRAL.F62C-k0 | 203 | 204 | 365 | 206 |
| MRAL.S63C-k0 | 203 | 204 | 366 | 206 |
| MRAL.S65C-k0 | 203 | 204 | 367 | 206 |
| MRAL.S67C-k0 | 203 | 204 | 368 | 206 |
| MRAL.G68C-k0 | 203 | 204 | 369 | 206 |
| MRAL.T69C-k0 | 203 | 204 | 370 | 206 |
| MRAL.D70C-k0 | 203 | 204 | 371 | 206 |
| MRAL.T72C-k0 | 203 | 204 | 372 | 206 |
| MRAL.F73C-k0 | 203 | 204 | 373 | 206 |
| MRAL.T74C-k0 | 203 | 204 | 374 | 206 |
| MRAL.I75C-k0 | 203 | 204 | 375 | 206 |
| MRAL.S76C-k0 | 203 | 204 | 376 | 206 |
| MRAL.S77C-k0 | 203 | 204 | 377 | 206 |
| MRAL.L78C-k0 | 203 | 204 | 378 | 206 |
| MRAL.Q79C-k0 | 203 | 204 | 379 | 206 |
| MRAL.F98C-k0 | 203 | 204 | 380 | 206 |
| MRAL.G99C-k0 | 203 | 204 | 381 | 206 |
| MRAL.Q100C-k0 | 203 | 204 | 382 | 206 |
| MRAL.G101C-k0 | 203 | 204 | 383 | 206 |
| MRAL.T102C-k0 | 203 | 204 | 384 | 206 |
| MRAL.K103C-k0 | 203 | 204 | 385 | 206 |
| MRAL.V104C-k0 | 203 | 204 | 386 | 206 |
| MRAL.E105C-k0 | 203 | 204 | 387 | 206 |
| MRAL.I106C-k0 | 203 | 204 | 388 | 206 |
| MRAL.K107C-k0 | 203 | 204 | 389 | 206 |
| MRAL.A25C-k0 | 203 | 204 | 390 | 206 |
| MRAL.S26C-k0 | 203 | 204 | 391 | 206 |
| MRAL.Q27C-k0 | 203 | 204 | 392 | 206 |
| MRAL.Y32C-k0 | 203 | 204 | 393 | 206 |
| MRAL.L33C-k0 | 203 | 204 | 394 | 206 |
| MRAL.N34C-k0 | 203 | 204 | 395 | 206 |
| MRAL.Y50C-k0 | 203 | 204 | 396 | 206 |
| MRAL.T51C-k0 | 203 | 204 | 397 | 206 |
| MRAL.H55C-k0 | 203 | 204 | 398 | 206 |
| MRAL.S56C-k0 | 203 | 204 | 399 | 206 |
| MRAL.Y96C-k0 | 203 | 204 | 400 | 206 |
| MRAL.T97C-k0 | 203 | 204 | 401 | 206 |
| MRAL-k0.R108C | 203 | 204 | 205 | 402 |
| MRAL-k0.T109C | 203 | 204 | 205 | 403 |
| MRAL-k0.V110C | 203 | 204 | 205 | 404 |
| MRAL-k0.A111C | 203 | 204 | 205 | 405 |
| MRAL-k0.A112C | 203 | 204 | 205 | 406 |
| MRAL-k0.P113C | 203 | 204 | 205 | 407 |
| MRAL-k0.S114C | 203 | 204 | 205 | 408 |
| MRAL-k0.V115C | 203 | 204 | 205 | 409 |
| MRAL-k0.F116C | 203 | 204 | 205 | 410 |
| MRAL-k0.P120C | 203 | 204 | 205 | 411 |
| MRAL-k0.S121C | 203 | 204 | 205 | 412 |

TABLE 37-continued

MRA variants

| Antibody name | SEQ ID NO: Heavy chain variable region | Heavy chain constant region | Light chain variable region | Light chain constant region |
|---|---|---|---|---|
| MRAL-k0.D122C | 203 | 204 | 205 | 413 |
| MRAL-k0.E123C | 203 | 204 | 205 | 414 |
| MRAL-k0.Q124C | 203 | 204 | 205 | 415 |
| MRAL-k0.L125C | 203 | 204 | 205 | 416 |
| MRAL-k0.K126C | 203 | 204 | 205 | 417 |
| MRAL-k0.S127C | 203 | 204 | 205 | 418 |
| MRAL-k0.G128C | 203 | 204 | 205 | 419 |
| MRAL-k0.T129C | 203 | 204 | 205 | 420 |
| MRAL-k0.A130C | 203 | 204 | 205 | 421 |
| MRAL-k0.S131C | 203 | 204 | 205 | 422 |
| MRAL-k0.L136C | 203 | 204 | 205 | 423 |
| MRAL-k0.N137C | 203 | 204 | 205 | 424 |
| MRAL-k0.N138C | 203 | 204 | 205 | 425 |
| MRAL-k0.F139C | 203 | 204 | 205 | 426 |
| MRAL-k0.Y140C | 203 | 204 | 205 | 427 |
| MRAL-k0.P141C | 203 | 204 | 205 | 428 |
| MRAL-k0.R142C | 203 | 204 | 205 | 429 |
| MRAL-k0.E143C | 203 | 204 | 205 | 430 |
| MRAL-k0.A144C | 203 | 204 | 205 | 431 |
| MRAL-k0.K145C | 203 | 204 | 205 | 432 |
| MRAL-k0.V146C | 203 | 204 | 205 | 433 |
| MRAL-k0.Q147C | 203 | 204 | 205 | 434 |
| MRAL-k0.W148C | 203 | 204 | 205 | 435 |
| MRAL-k0.K149C | 203 | 204 | 205 | 436 |
| MRAL-k0.V150C | 203 | 204 | 205 | 437 |
| MRAL-k0.D151C | 203 | 204 | 205 | 438 |
| MRAL-k0.N152C | 203 | 204 | 205 | 439 |
| MRAL-k0.A153C | 203 | 204 | 205 | 440 |
| MRAL-k0.L154C | 203 | 204 | 205 | 441 |
| MRAL-k0.Q155C | 203 | 204 | 205 | 442 |
| MRAL-k0.S156C | 203 | 204 | 205 | 443 |
| MRAL-k0.G157C | 203 | 204 | 205 | 444 |
| MRAL-k0.N158C | 203 | 204 | 205 | 445 |
| MRAL-k0.S159C | 203 | 204 | 205 | 446 |
| MRAL-k0.Q160C | 203 | 204 | 205 | 447 |
| MRAL-k0.E161C | 203 | 204 | 205 | 448 |
| MRAL-k0.S162C | 203 | 204 | 205 | 449 |
| MRAL-k0.V163C | 203 | 204 | 205 | 450 |
| MRAL-k0.T164C | 203 | 204 | 205 | 451 |
| MRAL-k0.E165C | 203 | 204 | 205 | 452 |
| MRAL-k0.Q166C | 203 | 204 | 205 | 453 |
| MRAL-k0.D167C | 203 | 204 | 205 | 454 |
| MRAL-k0.S168C | 203 | 204 | 205 | 455 |
| MRAL-k0.K169C | 203 | 204 | 205 | 456 |
| MRAL-k0.D170C | 203 | 204 | 205 | 457 |
| MRAL-k0.S171C | 203 | 204 | 205 | 458 |
| MRAL-k0.T172C | 203 | 204 | 205 | 459 |
| MRAL-k0.Y173C | 203 | 204 | 205 | 460 |
| MRAL-k0.S174C | 203 | 204 | 205 | 461 |
| MRAL-k0.L175C | 203 | 204 | 205 | 462 |
| MRAL-k0.T180C | 203 | 204 | 205 | 463 |
| MRAL-k0.L181C | 203 | 204 | 205 | 464 |
| MRAL-k0.S182C | 203 | 204 | 205 | 465 |
| MRAL-k0.K183C | 203 | 204 | 205 | 466 |
| MRAL-k0.A184C | 203 | 204 | 205 | 467 |
| MRAL-k0.D185C | 203 | 204 | 205 | 468 |
| MRAL-k0.Y186C | 203 | 204 | 205 | 469 |
| MRAL-k0.E187C | 203 | 204 | 205 | 470 |
| MRAL-k0.K188C | 203 | 204 | 205 | 471 |
| MRAL-k0.H189C | 203 | 204 | 205 | 472 |
| MRAL-k0.K190C | 203 | 204 | 205 | 473 |
| MRAL-k0.V191C | 203 | 204 | 205 | 474 |
| MRAL-k0.Y192C | 203 | 204 | 205 | 475 |
| MRAL-k0.A193C | 203 | 204 | 205 | 476 |
| MRAL-k0.E195C | 203 | 204 | 205 | 477 |
| MRAL-k0.V196C | 203 | 204 | 205 | 478 |
| MRAL-k0.T197C | 203 | 204 | 205 | 479 |
| MRAL-k0.H198C | 203 | 204 | 205 | 480 |
| MRAL-k0.Q199C | 203 | 204 | 205 | 481 |
| MRAL-k0.G200C | 203 | 204 | 205 | 482 |
| MRAL-k0.L201C | 203 | 204 | 205 | 483 |

TABLE 37-continued

MRA variants

| Antibody name | SEQ ID NO: Heavy chain variable region | Heavy chain constant region | Light chain variable region | Light chain constant region |
|---|---|---|---|---|
| MRAL-k0.S202C | 203 | 204 | 205 | 484 |
| MRAL-k0.S203C | 203 | 204 | 205 | 485 |
| MRAL-k0.P204C | 203 | 204 | 205 | 486 |
| MRAL-k0.V205C | 203 | 204 | 205 | 487 |
| MRAL-k0.T206C | 203 | 204 | 205 | 488 |
| MRAL-k0.K207C | 203 | 204 | 205 | 489 |
| MRAL-k0.S208C | 203 | 204 | 205 | 490 |
| MRAL-k0.F209C | 203 | 204 | 205 | 491 |
| MRAL-k0.N210C | 203 | 204 | 205 | 492 |
| MRAL-k0.R211C | 203 | 204 | 205 | 493 |
| MRAL-k0.G212C | 203 | 204 | 205 | 494 |
| MRAL-k0.E213C | 203 | 204 | 205 | 495 |

Reference Example 16.2 Assessment of Protease-Mediated Fab Fragmentation of Antibodies Having Cysteine Substitution at Various Positions in the Light Chain Using a protease that cleaves the heavy chain hinge region of antibody to cause Fab fragmentation, the MRA variants produced in Example 16.1 were examined for whether they acquired protease resistance so that their fragmentation would be inhibited. The protease used was Lys-C(Endoproteinase Lys-C' Sequencing Grade) (SIGMA; 11047825001). Reaction was performed under the conditions of 2 ng/micro L protease, 100 micro g/mL antibody, 80% 25 mM Tris-HCl pH 8.0, 20% PBS, and 35 degrees C. for two hours, or under the conditions of 2 ng/micro L protease, 20 micro g/mL antibody, 80% 25 mM Tris-HCl pH 8.0, 20% PBS, and 35 degrees C., for one hour. The sample was then subjected to non-reducing capillary electrophoresis. Wes (Protein Simple) was used for capillary electrophoresis, and an HRP-labeled anti-kappa chain antibody (abcam; ab46527) was used for detection.

The results are shown in FIGS. 35 to 44. Lys-C treatment of MRA caused cleavage of the heavy chain hinge region, resulting in disappearance of the band of IgG at around 150 kDa and appearance of the band of Fab at around 50 kDa. For the MRA variants produced in Reference Example 16.1, some showed the band of Fab dimer appearing at around 96 kDa and some showed the band of undigested IgG detected at around 150 kDa after the protease treatment. The area of each band obtained after the protease treatment was outputted using software dedicated for Wes (Compass for SW; Protein Simple) to calculate the percentage of the band areas of undigested IgG, Fab dimer, etc. The calculated percentage of each band is shown in Table 38.

TABLE 38

| Antibody name | IgG (%) | Fab-Fab (%) | Fab (%) | Heavy chain SEQ ID NO: | Light chain SEQ ID NO: |
|---|---|---|---|---|---|
| MRAL.T5C-k0 | 0.1 | 0 | 71.1 | 201 | 342 |
| MRAL.Q6C-k0 | 0.1 | 0 | 74.5 | 201 | 343 |
| MRAL.S7C-k0 | 0.2 | 0 | 68.8 | 201 | 344 |
| MRAL.P8C-k0 | no data | no data | no data | 201 | 345 |
| MRAL.S9C-k0 | 0.3 | 0.4 | 82.9 | 201 | 346 |

TABLE 38-continued

| Antibody name | IgG (%) | Fab-Fab (%) | Fab (%) | Heavy chain SEQ ID NO: | Light chain SEQ ID NO: |
|---|---|---|---|---|---|
| MRAL.S10C-k0 | 0.2 | 0.4 | 85.8 | 201 | 347 |
| MRAL.L11C-k0 | 0 | 0 | 83.4 | 201 | 348 |
| MRAL.S12C-k0 | 0.9 | 0.4 | 87.2 | 201 | 349 |
| MRAL.A13C-k0 | 0.1 | 0 | 88.6 | 201 | 350 |
| MRAL.S14C-k0 | 0.3 | 0.6 | 85.9 | 201 | 351 |
| MRAL.V15C-k0 | 0.2 | 0 | 84.8 | 201 | 352 |
| MRAL.G16C-k0 | 0.8 | 0 | 82.3 | 201 | 353 |
| MRAL.D17C-k0 | 0 | 0 | 92.3 | 201 | 354 |
| MRAL.R18C-k0 | 0.2 | 0.4 | 87.1 | 201 | 355 |
| MRAL.V19C-k0 | 0 | 0 | 63.3 | 201 | 356 |
| MRAL.T20C-k0 | 0.5 | 0.6 | 83.6 | 201 | 357 |
| MRAL.I21C-k0 | 0 | 0 | 5 | 201 | 358 |
| MRAL.T22C-k0 | 0 | 0.3 | 89.5 | 201 | 359 |
| MRAL.G57C-k0 | 0.2 | 0 | 91.7 | 201 | 360 |
| MRAL.V58C-k0 | 0.4 | 0.7 | 88 | 201 | 361 |
| MRAL.P59C-k0 | 0.7 | 1.5 | 94.6 | 201 | 362 |
| MRAL.S60C-k0 | 0.1 | 0 | 86.9 | 201 | 363 |
| MRAL.R61C-k0 | 0 | 0.3 | 86.9 | 201 | 364 |
| MRAL.F62C-k0 | 0.2 | 0 | 60 | 201 | 365 |
| MRAL.S63C-k0 | 0.5 | 0.6 | 88.1 | 201 | 366 |
| MRAL.S65C-k0 | 0.4 | 0.8 | 83.3 | 201 | 367 |
| MRAL.S67C-k0 | 1.5 | 0 | 72.8 | 201 | 368 |
| MRAL.G68C-k0 | 0.7 | 0.9 | 83.9 | 201 | 369 |
| MRAL.T69C-k0 | 1.1 | 0.6 | 86.4 | 201 | 370 |
| MRAL.D70C-k0 | 0.8 | 0.9 | 88.2 | 201 | 371 |
| MRAL.T72C-k0 | 0.6 | 0.7 | 90.1 | 201 | 372 |
| MRAL.F73C-k0 | 0.3 | 0 | 59.5 | 201 | 373 |
| MRAL.T74C-k0 | 0.2 | 0.6 | 95.6 | 201 | 374 |
| MRAL.I75C-k0 | no data | no data | no data | 201 | 375 |
| MRAL.S76C-k0 | 0.6 | 0.8 | 90.4 | 201 | 376 |
| MRAL.S77C-k0 | 1.1 | 0 | 74.2 | 201 | 377 |
| MRAL.L78C-k0 | 4.9 | 0 | 54.7 | 201 | 378 |
| MRAL.Q79C-k0 | 1.2 | 0.6 | 93.1 | 201 | 379 |
| MRAL.F98C-k0 | 0.6 | 0.8 | 71.8 | 201 | 380 |
| MRAL.G99C-k0 | 0.6 | 0.4 | 88.2 | 201 | 381 |
| MRAL.Q100C-k0 | 5 | 0.8 | 85 | 201 | 382 |
| MRAL.G101C-k0 | 0.3 | 0.4 | 98.1 | 201 | 383 |
| MRAL.T102C-k0 | 0.3 | 0 | 52.8 | 201 | 384 |
| MRAL.K103C-k0 | 1.1 | 0.4 | 89.2 | 201 | 385 |
| MRAL.V104C-k0 | 0.2 | 0.6 | 48.2 | 201 | 386 |
| MRAL.E105C-k0 | 90.8 | 0 | 1.2 | 201 | 387 |
| MRAL.I106C-k0 | 1.8 | 0 | 47.3 | 201 | 388 |
| MRAL.K107C-k0 | 5.4 | 0 | 82.6 | 201 | 389 |
| MRAL.A25C-k0 | 0.1 | 0.5 | 80 | 201 | 390 |
| MRAL.S26C-k0 | 0.3 | 1.4 | 94 | 201 | 391 |
| MRAL.Q27C-k0 | 0.3 | 1.3 | 94.6 | 201 | 392 |
| MRAL.Y32C-k0 | 0 | 1.2 | 95.7 | 201 | 393 |
| MRAL.L33C-k0 | 0 | 0 | 79.2 | 201 | 394 |
| MRAL.N34C-k0 | 0.3 | 0.4 | 95.7 | 201 | 395 |
| MRAL.Y50C-k0 | 0.4 | 1.3 | 97 | 201 | 396 |
| MRAL.T51C-k0 | 0.2 | 1.2 | 96.9 | 201 | 397 |
| MRAL.H55C-k0 | 0.2 | 1.5 | 95.7 | 201 | 398 |
| MRAL.S56C-k0 | 0.1 | 0.8 | 97 | 201 | 399 |
| MRAL.Y96C-k0 | 0.1 | 0.2 | 91.3 | 201 | 400 |
| MRAL.T97C-k0 | 0.3 | 0.9 | 97.5 | 201 | 401 |
| MRAL-k0.R108C | no data | no data | no data | 201 | 402 |
| MRAL-k0.T109C | 0.5 | 16 | 74.5 | 201 | 403 |
| MRAL-k0.V110C | 1.2 | 4 | 75 | 201 | 404 |
| MRAL-k0.A111C | 0.2 | 0.7 | 85.9 | 201 | 405 |
| MRAL-k0.A112C | 3.3 | 6.1 | 80.3 | 201 | 406 |
| MRAL-k0.P113C | no data | no data | no data | 201 | 407 |
| MRAL-k0.S114C | 0.3 | 0.7 | 94 | 201 | 408 |
| MRAL-k0.V115C | 0 | 0.1 | 34.9 | 201 | 409 |
| MRAL-k0.F116C | 0.3 | 0.3 | 77.3 | 201 | 410 |
| MRAL-k0.P120C | 0 | 0 | 28.8 | 201 | 411 |
| MRAL-k0.S121C | 8.6 | 0 | 57.4 | 201 | 412 |
| MRAL-k0.D122C | 1.8 | 0.1 | 30.3 | 201 | 413 |
| MRAL-k0.E123C | 2.3 | 1.6 | 75.9 | 201 | 414 |
| MRAL-k0.Q124C | 1.3 | 0.9 | 50.4 | 201 | 415 |
| MRAL-k0.L125C | 0.4 | 0.1 | 66.6 | 201 | 416 |
| MRAL-k0.K126C | 59.3 | 9.9 | 16.5 | 201 | 417 |
| MRAL-k0.S127C | 0.3 | 0.9 | 79 | 201 | 418 |
| MRAL-k0.G128C | 0.2 | 7 | 71.5 | 201 | 419 |
| MRAL-k0.T129C | 0 | 0.4 | 76.2 | 201 | 420 |
| MRAL-k0.A130C | 0 | 0 | 49.9 | 201 | 421 |

TABLE 38-continued

| Antibody name | IgG (%) | Fab-Fab (%) | Fab (%) | Heavy chain SEQ ID NO: | Light chain SEQ ID NO: |
|---|---|---|---|---|---|
| MRAL-k0.S131C | 0 | 0 | 16.7 | 201 | 422 |
| MRAL-k0.L136C | 0 | 0 | 15 | 201 | 423 |
| MRAL-k0.N137C | 0 | 0 | 47.5 | 201 | 424 |
| MRAL-k0.N138C | 0 | 0.5 | 86.8 | 201 | 425 |
| MRAL-k0.F139C | 0 | 0 | 0 | 201 | 426 |
| MRAL-k0.Y140C | 0 | 0 | 29.9 | 201 | 427 |
| MRAL-k0.P141C | 0.1 | 2.7 | 79.8 | 201 | 428 |
| MRAL-k0.R142C | 0 | 0.6 | 74.1 | 201 | 429 |
| MRAL-k0.E143C | 0 | 0.5 | 88.4 | 201 | 430 |
| MRAL-k0.A144C | 0 | 0.1 | 42.1 | 201 | 431 |
| MRAL-k0.K145C | 0 | 0.9 | 82.8 | 201 | 432 |
| MRAL-k0.V146C | 0 | 0 | 26.5 | 201 | 433 |
| MRAL-k0.Q147C | 0 | 1.8 | 78.5 | 201 | 434 |
| MRAL-k0.W148C | no data | no data | no data | 201 | 435 |
| MRAL-k0.K149C | 0 | 0.6 | 79.5 | 201 | 436 |
| MRAL-k0.V150C | 0 | 0 | 34.8 | 201 | 437 |
| MRAL-k0.D151C | 2.7 | 14.9 | 66.5 | 201 | 438 |
| MRAL-k0.N152C | 1.2 | 58.4 | 26.8 | 201 | 439 |
| MRAL-k0.A153C | 0 | 7.1 | 71.8 | 201 | 440 |
| MRAL-k0.L154C | 0 | 2.3 | 66.5 | 201 | 441 |
| MRAL-k0.Q155C | 0 | 0.6 | 73.3 | 201 | 442 |
| MRAL-k0.S156C | 0.3 | 32.3 | 40.5 | 201 | 443 |
| MRAL-k0.G157C | 0 | 1.4 | 71.8 | 201 | 444 |
| MRAL-k0.N158C | 0 | 0.7 | 76.2 | 201 | 445 |
| MRAL-k0.S159C | 0 | 1.1 | 74.7 | 201 | 446 |
| MRAL-k0.Q160C | 0 | 1.5 | 78.5 | 201 | 447 |
| MRAL-k0.E161C | 0 | 1 | 79.8 | 201 | 448 |
| MRAL-k0.S162C | 0.6 | 1.6 | 86.7 | 201 | 449 |
| MRAL-k0.V163C | 0 | 1.7 | 87.1 | 201 | 450 |
| MRAL-k0.T164C | 0 | 2.6 | 84.3 | 201 | 451 |
| MRAL-k0.E165C | 0 | 0.6 | 89.5 | 201 | 452 |
| MRAL-k0.Q166C | 0 | 2 | 86.2 | 201 | 453 |
| MRAL-k0.D167C | 0 | 0.5 | 90.5 | 201 | 454 |
| MRAL-k0.S168C | 0 | 0.8 | 94.1 | 201 | 455 |
| MRAL-k0.K169C | 0 | 0.4 | 95.3 | 201 | 456 |
| MRAL-k0.D170C | 0.2 | 0.1 | 96 | 201 | 457 |
| MRAL-k0.S171C | 0 | 0.1 | 93.8 | 201 | 458 |
| MRAL-k0.T172C | 0 | 0 | 77.4 | 201 | 459 |
| MRAL-k0.Y173C | no data | no data | no data | 201 | 460 |
| MRAL-k0.S174C | 0 | 0 | 65.8 | 201 | 461 |
| MRAL-k0.L175C | 0 | 0.2 | 59.3 | 201 | 462 |
| MRAL-k0.T180C | 0 | 0.3 | 93.3 | 201 | 463 |
| MRAL-k0.L181C | 1.3 | 0.6 | 86.4 | 201 | 464 |
| MRAL-k0.S182C | 0.9 | 1.9 | 95 | 201 | 465 |
| MRAL-k0.K183C | 4.4 | 0.9 | 90.7 | 201 | 466 |
| MRAL-k0.A184C | 1.6 | 27.9 | 67.7 | 201 | 467 |
| MRAL-k0.D185C | 0.5 | 1.1 | 96.5 | 201 | 468 |
| MRAL-k0.Y186C | 2.4 | 18.9 | 67.4 | 201 | 469 |
| MRAL-k0.E187C | 2.3 | 0 | 11.2 | 201 | 470 |
| MRAL-k0.K188C | 1.8 | 8.6 | 85.8 | 201 | 471 |
| MRAL-k0.H189C | 1 | 0.8 | 93 | 201 | 472 |
| MRAL-k0.K190C | 25.5 | 0.2 | 11.4 | 201 | 473 |
| MRAL-k0.V191C | 2.8 | 1.6 | 84 | 201 | 474 |
| MRAL-k0.Y192C | 0.4 | 1.1 | 67.5 | 201 | 475 |
| MRAL-k0.A193C | 1.7 | 1.4 | 94.5 | 201 | 476 |
| MRAL-k0.E195C | 0.9 | 1.7 | 95.5 | 201 | 477 |
| MRAL-k0.V196C | 1 | 1.1 | 67.5 | 201 | 478 |
| MRAL-k0.T197C | 0.8 | 1.5 | 94.8 | 201 | 479 |
| MRAL-k0.H198C | 0.7 | 1.3 | 85 | 201 | 480 |
| MRAL-k0.Q199C | 1.4 | 2.5 | 92.9 | 201 | 481 |
| MRAL-k0.G200C | 7.3 | 14.8 | 75.6 | 201 | 482 |
| MRAL-k0.L201C | 1.7 | 5 | 88 | 201 | 483 |
| MRAL-k0.S202C | 2.8 | 46.4 | 49.4 | 201 | 484 |
| MRAL-k0.S203C | 9.1 | 0 | 87.1 | 201 | 485 |
| MRAL-k0.P204C | 1 | 0 | 95.8 | 201 | 486 |
| MRAL-k0.V205C | 1.7 | 1 | 88.4 | 201 | 487 |
| MRAL-k0.T206C | 1.4 | 0.7 | 90.1 | 201 | 488 |
| MRAL-k0.K207C | 3.2 | 0.5 | 79.8 | 201 | 489 |
| MRAL-k0.S208C | 7.7 | 0.8 | 77.8 | 201 | 490 |
| MRAL-k0.F209C | 0 | 0 | 37.2 | 201 | 491 |
| MRAL-k0.N210C | 22.8 | 0 | 20.2 | 201 | 492 |
| MRAL-k0.R211C | 9.2 | 0 | 59.7 | 201 | 493 |
| MRAL-k0.G212C | 58.9 | 0 | 28.7 | 201 | 494 |
| MRAL-k0.E213C | 55.1 | 0 | 12.1 | 201 | 495 |

From this result, it was found that cysteine substitution in the light chain variable region or light chain constant region improved the protease resistance of the heavy chain hinge region in the MRA variants shown in Table 39. Alternatively, the result suggested that a Fab dimer was formed by a covalent bond between the Fab-Fab.

TABLE 39

MRA variants

| Antibody name | SEQ ID NO: Heavy chain variable region | Heavy chain constant region | Light chain variable region | Light chain constant region |
|---|---|---|---|---|
| MRAL.Q100C-k0 | 203 | 204 | 382 | 206 |
| MRAL.E105C-k0 | 203 | 204 | 387 | 206 |
| MRAL.K107C-k0 | 203 | 204 | 389 | 206 |
| MRAL-k0.T109C | 203 | 204 | 205 | 403 |
| MRAL-k0.A112C | 203 | 204 | 205 | 406 |
| MRAL-k0.S121C | 203 | 204 | 205 | 412 |
| MRAL-k0.K126C | 203 | 204 | 205 | 417 |
| MRAL-k0.G128C | 203 | 204 | 205 | 419 |
| MRAL-k0.D151C | 203 | 204 | 205 | 438 |
| MRAL-k0.N152C | 203 | 204 | 205 | 439 |
| MRAL-k0.A153C | 203 | 204 | 205 | 440 |
| MRAL-k0.S156C | 203 | 204 | 205 | 443 |
| MRAL-k0.A184C | 203 | 204 | 205 | 467 |
| MRAL-k0.Y186C | 203 | 204 | 205 | 469 |
| MRAL-k0.K188C | 203 | 204 | 205 | 471 |
| MRAL-k0.K190C | 203 | 204 | 205 | 473 |
| MRAL-k0.G200C | 203 | 204 | 205 | 482 |
| MRAL-k0.L201C | 203 | 204 | 205 | 483 |
| MRAL-k0.S202C | 203 | 204 | 205 | 484 |
| MRAL-k0.S203C | 203 | 204 | 205 | 485 |
| MRAL-k0.S208C | 203 | 204 | 205 | 490 |
| MRAL-k0.N210C | 203 | 204 | 205 | 492 |
| MRAL-k0.R211C | 203 | 204 | 205 | 493 |
| MRAL-k0.G212C | 203 | 204 | 205 | 494 |
| MRAL-k0.E213C | 203 | 204 | 205 | 495 |

[Reference Example 17] Study of Methods for Assessing Antibodies Having Cysteine Substitution

Reference Example 17.1 Production of Antibodies Having Cysteine Substitution in the Light Chain The amino acid residue at position 126 according to Kabat numbering in the light chain constant region (k0, SEQ ID NO: 206) of MRA, an anti-human IL6R neutralizing antibody (heavy chain: MRAH-G1T4 (SEQ ID NO: 201), light chain: MRAL-k0 (SEQ ID NO: 202)), was substituted with cysteine to produce a variant of the light chain constant region of MRA, k0.K126C (SEQ ID No: 417). This variant of the light chain constant region of MRA was linked with the MRA light chain variable region (MRAL, SEQ ID NO: 205) to produce a variant of the light chain of MRA, and an expression vector encoding the corresponding gene was produced by a method known to the person skilled in the art.

The MRA light chain variant produced above was combined with the MRA heavy chain. The resultant MRA variant MRAL-k0.K126C (heavy chain: MRAH-G1T4 (SEQ ID NO: 201), light chain variable region: MRAL (SEQ ID NO: 205), light chain constant region: k0.K126C (SEQ ID NO: 417)) was expressed by transient expression using FreeStyle293 cells (Invitrogen) or Expi293 cells (Life technologies) by a method known to the person skilled in the art, and purified with Protein A by a method known to the person skilled in the art.

Reference Example 17.2 Assessment of Protease-Mediated Capillary Electrophoresis of Antibodies Having Cysteine Substitution in the Light Chain Using a protease that cleaves the heavy chain hinge region of antibody to cause Fab fragmentation, the MRA light chain variant produced in Reference Example 17.1 was examined for whether it acquired protease resistance so that its fragmentation would be inhibited. The protease used was Lys-C(Endoproteinase Lys-C Sequencing Grade) (SIGMA: 11047825001). Reaction was performed under the conditions of 0.1, 0.4, 1.6, or 6.4 ng/micro L protease, 100 micro g/mL antibody, 80% 25 mM Tris-HCl pH 8.0, 20% PBS, and 35 degrees C., for two hours. The sample was then subjected to non-reducing capillary electrophoresis. Wes (Protein Simple) was used for capillary electrophoresis, and an HRP-labeled anti-kappa chain antibody (abcam: ab46527) or an HRP-labeled anti-human Fc antibody (Protein Simple: 043-491) was used for detection.

The result is shown in FIG. 45. For MRA treated with Lys-C, detection with the anti-kappa chain antibody showed disappearance of the band at around 150 kDa and appearance of a new band at around 50 kDa, and, at low Lys-C concentrations, also showed appearance of a slight band at 113 kDa. Detection with the anti-human Fc antibody showed disappearance of the band at around 150 kDa and appearance of a new band at around 61 kDa, and, at low Lys-C concentrations, also showed appearance of a slight band at 113 kDa. For the MRA variant produced in Reference Example 17.1, on the other hand, the band at around 150 k Da hardly disappeared, and a new band appeared at around 96 kDa. Detection with the anti-human Fc antibody showed that the band at around 150 kDa hardly disappeared and a new band appeared at around 61 kDa. and, at low Lys-C concentrations, a slight band also appeared at 113 kDa. The above results suggested that, as shown in FIG. 46, the band at around 150 kDa was IgG, the band at around 113 kDa was a one-arm form in which the heavy chain hinge was cleaved once, the band at around 96 kDa was a Fab dimer, the band at around 61 kDa was Fc, and the band at around 50 k Da was Fab.

SEQUENCE LISTING (513 sequences)

SEQ ID NO: 1 - protein, 128 aa, Artificial Sequence
  An artificially synthesized sequence
QVQLVESGGGLVQPGRSLRLSCAASGFKFSNVWMHWVRQAPGKGLEWVAQIKDKWNAYAAYYAPSVKGRFTISRDDSKNSIYLQMNSLKTEDTAVYYCHYIHYASASTLLPAFGIDAWGQGTTVTVSS

SEQ ID NO: 2 - protein, 128 aa, Artificial Sequence
  An artificially synthesized sequence
QVQLVESGGGLVQPGRSLRLSCAASGFVFSNVWFHWVRQAPGKGLEWVAQIKDKWNAYADYYAPSVKERFTISRDDSKNSIYLQMNSLKTEDTAVYYCHYIHYASASTLLPAEGIDAWGQGTTVTVSS

SEQ ID NO: 3 - protein, 128 aa, Artificial Sequence
  An artificially synthesized sequence
QVQLVESGGGLVQPGRSLRLSCAASGFKFSNTWMHWVRQAPGKGLEWVAQIKDKYNAYAAYYAPSVKGRFTISRDDSKNSIYLQMNSLKTEDTAVYYCHYIHYASASTLLPAFGVDAWGQGTTVTVSS

SEQ ID NO: 4 - protein, 128 aa, Artificial Sequence
  An artificially synthesized sequence
QVQLVESGGGLVQPGRSLRLSCAASGFKFSNVWFHWVRQAPGKGLEWVAQIKDKYNAYATYYAPSVKGRFTISRDDSKNSIYLQMNSLKTEDTAVYYCHYVHYASASTLLPAFGVDAWGQGTTVTVSS

SEQ ID NO: 5 - protein, 128 aa, Artificial Sequence
  An artificially synthesized sequence
QVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAFGVDAWGQGTTVTVSS

SEQ ID NO: 6 - protein, 128 aa, Artificial Sequence
  An artificially synthesized sequence
QVQLVESGGGLVQPGRSLRLSCAASGFKFSHVWFHWVRQAPGKGLEWVAQIKDKYNAYAAYYAPSVKGRFTISRDDSKNSIYLQMNSLKTEDTAVYYCHYVHYASASTLLPAFGVDAWGQGTTVTVSS

SEQ ID NO: 7 - protein, 128 aa, Artificial Sequence
  An artificially synthesized sequence
QVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSS

SEQ ID NO: 8 - protein, 128 aa, Artificial Sequence
  An artificially synthesized sequence
QVQLVESGGGLVQPGRSLRLSCAASGFKFSNVWMHWVRQAPGKGLEWVAQIKDKYNAYAAYYAPSVKGRFTISRDDSKNSIYLQMNSLKTEDTAVYYCHYVHYASASTLLPAFGVDAWGQGTTVTVSS

SEQ ID NO: 9 - protein, 128 aa, Artificial Sequence
  An artificially synthesized sequence
QVQLVESGGGLVQPGRSLRLSCAASGFKFSNVWFHWVRQAPGKGLEWVAQIKDKYNAYAAYYAPSVKGRFTISRDDSKNSIYLQMNSLKTEDTAVYYCHYVHYASASTLLPAEGVDAWGQGTTVTVSS

SEQ ID NO: 10 - protein, 128 aa, Artificial Sequence
  An artificially synthesized sequence
QVQLVESGGGLVQPGRSLRLSCAASGFKFSNTWFHWVRQAPGKGLEWVAQIKDYYNDYAAYYAPSVKGRFTISRDDSKNSIYLQMNSLKTEDTAVYYCHYVHYASASTLLPAEGVDAWGQGTTVTVSS

SEQ ID NO: 11 - protein, 128 aa, Artificial Sequence
  An artificially synthesized sequence
QVQLVESGGGLVQPGRSLRLSCAASGFTFSNAWMHWVRQAPGKGLEWVAQIKDKGNAYAAYYAPSVKGRFTISRDDSKNSIYLQMNSLKTEDTAVYYCRYVHYASASTLLPAFGVDAWGQGTTVTVSS

SEQ ID NO: 12 - protein, 5 aa, Artificial Sequence
  An artificially synthesized sequence
NVWMH

SEQ ID NO: 13 - protein, 5 aa, Artificial Sequence
  An artificially synthesized sequence
NVWFH

SEQ ID NO: 14 - protein, 5 aa, Artificial Sequence
  An artificially synthesized sequence
NTWMH

SEQ ID NO: 15 - protein, 5 aa, Artificial Sequence
  An artificially synthesized sequence
NVWFH

SEQ ID NO: 16 - protein, 5 aa, Artificial Sequence
  An artificially synthesized sequence
NVWFH

SEQ ID NO: 17 - protein, 5 aa, Artificial Sequence
  An artificially synthesized sequence
HVWFH

SEQ ID NO: 18 - protein, 5 aa, Artificial Sequence
  An artificially synthesized sequence
NVWFH

SEQ ID NO: 19 - protein, 5 aa, Artificial Sequence
  An artificially synthesized sequence
NVWMH

SEQ ID NO: 20 - protein, 5 aa, Artificial Sequence
  An artificially synthesized sequence
NVWFH

SEQ ID NO: 21 - protein, 5 aa, Artificial Sequence
  An artificially synthesized sequence
NTWFH

SEQ ID NO: 22 - protein, 5 aa, Artificial Sequence
  An artificially synthesized sequence
NAWMH

SEQ ID NO: 23 - protein, 19 aa, Artificial Sequence
  An artificially synthesized sequence
QIKDKWNAYAAYYAPSVKG

SEQ ID NO: 24 - protein, 19 aa, Artificial Sequence
  An artificially synthesized sequence
QIKDKWNAYADYYAPSVKE

SEQ ID NO: 25 - protein, 19 aa, Artificial Sequence
  An artificially synthesized sequence
QIKDKYNAYAAYYAPSVKG

SEQ ID NO: 26 - protein, 19 aa, Artificial Sequence
  An artificially synthesized sequence
QIKDKYNAYATYYAPSVKG

SEQ ID NO: 27 - protein, 19 aa, Artificial Sequence
  An artificially synthesized sequence
QIKDYYNAYAAYYAPSVKG

SEQ ID NO: 28 - protein, 19 aa, Artificial Sequence
  An artificially synthesized sequence
QIKDKYNAYAAYYAPSVKG

SEQ ID NO: 29 - protein, 19 aa, Artificial Sequence
  An artificially synthesized sequence
QIKDYYNAYAAYYAPSVKG

SEQ ID NO: 30 - protein, 19 aa, Artificial Sequence
  An artificially synthesized sequence
QIKDKYNAYAAYYAPSVKG

SEQ ID NO: 31 - protein, 19 aa, Artificial Sequence
  An artificially synthesized sequence
QIKDKYNAYAAYYAPSVKG

SEQ ID NO: 32 - protein, 19 aa, Artificial Sequence
  An artificially synthesized sequence
QIKDYYNDYAAYYAPSVKG

SEQ ID NO: 33 - protein, 19 aa, Artificial Sequence
  An artificially synthesized sequence
QIKDKGNAYAAYYAPSVKG

SEQ ID NO: 34 - protein, 17 aa, Artificial Sequence
  An artificially synthesized sequence
IHYASASTLLPAFGIDA

SEQ ID NO: 35 - protein, 17 aa, Artificial Sequence
  An artificially synthesized sequence
IHYASASTLLPAEGIDA

SEQ ID NO: 36 - protein, 17 aa, Artificial Sequence
  An artificially synthesized sequence
IHYASASTLLPAFGVDA

SEQ ID NO: 37 - protein, 17 aa, Artificial Sequence
  An artificially synthesized sequence
VHYASASTLLPAFGVDA

SEQ ID NO: 38 - protein, 17 aa, Artificial Sequence
  An artificially synthesized sequence
VHYASASTLLPAFGVDA

SEQ ID NO: 39 - protein, 17 aa, Artificial Sequence
  An artificially synthesized sequence
VHYASASTLLPAFGVDA

SEQ ID NO: 40 - protein, 17 aa, Artificial Sequence
  An artificially synthesized sequence
VHYASASTLLPAEGVDA

SEQ ID NO: 41 - protein, 17 aa, Artificial Sequence
  An artificially synthesized sequence
VHYASASTLLPAFGVDA

SEQ ID NO: 42 - protein, 17 aa, Artificial Sequence
  An artificially synthesized sequence
VHYASASTLLPAEGVDA

SEQ ID NO: 43 - protein, 17 aa, Artificial Sequence
  An artificially synthesized sequence
VHYASASTLLPAEGVDA

SEQ ID NO: 44 - protein, 17 aa, Artificial Sequence
  An artificially synthesized sequence
VHYASASTLLPAFGVDA

SEQ ID NO: 45 - protein, 112 aa, Artificial Sequence
  An artificially synthesized sequence
DIVMTQSPLSLPVTPGEPASISCQPSQEVVHMNRNTYLHWYQQKPGQAPRLLIYKVSNRFPGVPDRFSGSGSGTDFTLKISRVEAEDVGVYYCAQGTSHPFTFGQGTKLEIK

SEQ ID NO: 46 - protein, 112 aa, Artificial Sequence
  An artificially synthesized sequence
DIVMTQSPLSLPVTPGEPASISCQPSEEVVHMNRNTYLHWYQQKPGQAPRLLIYKVSNLFPGVPDRFSGSGSGTDFTLKISRVEAEDVGVYYCAQGTHHPFTFGQGTKLEIK

SEQ ID NO: 47 - protein, 112 aa, Artificial Sequence
  An artificially synthesized sequence
DIVMTQSPLSLPVTPGEPASISCQPSQEVVHMNNVVYLHWYQQKPGQAPRLLIYKVSNRFPGVPDRFSGSGSGTDFTLKISRVEAEDVGVYYCAQGTSHPFTFGQGTKLEIK

SEQ ID NO: 48 - protein, 112 aa, Artificial Sequence
  An artificially synthesized sequence
DIVMTQSPLSLPVTPGEPASISCQASQELVHMNRNTYLHWYQQKPGQAPRLLIYKVSNRFPGVPDRFSGSGSGTDFTLKISRVEAEDVGVYYCAQGTSVPFTFGQGTKLEIK

SEQ ID NO: 49 - protein, 16 aa, Artificial Sequence
  An artificially synthesized sequence
QPSQEVVHMNRNTYLH

SEQ ID NO: 50 - protein, 16 aa, Artificial Sequence
  An artificially synthesized sequence
QPSEEVVHMNRNTYLH

SEQ ID NO: 51 - protein, 16 aa, Artificial Sequence
  An artificially synthesized sequence
QPSQEVVHMNNVVYLH

SEQ ID NO: 52 - protein, 16 aa, Artificial Sequence
  An artificially synthesized sequence
QASQELVHMNRNTYLH

SEQ ID NO: 53 - protein, 7 aa, Artificial Sequence
  An artificially synthesized sequence
KVSNRFP

SEQ ID NO: 54 - protein, 7 aa, Artificial Sequence
  An artificially synthesized sequence
KVSNLFP

SEQ ID NO: 55 - protein, 7 aa, Artificial Sequence
  An artificially synthesized sequence
KVSNRFP

SEQ ID NO: 56 - protein, 7 aa, Artificial Sequence
  An artificially synthesized sequence
KVSNRFP

SEQ ID NO: 57 - protein, 9 aa, Artificial Sequence
  An artificially synthesized sequence
AQGTSHPFT

SEQ ID NO: 58 - protein, 9 aa, Artificial Sequence
  An artificially synthesized sequence
AQGTHHPFT

SEQ ID NO: 59 - protein, 9 aa, Artificial Sequence
  An artificially synthesized sequence
AQGTSHPFT

SEQ ID NO: 60 - protein, 9 aa, Artificial Sequence
  An artificially synthesized sequence
AQGTSVPFT

SEQ ID NO: 61 - protein, 128 aa, Artificial Sequence
  An artificially synthesized sequence
QVQLVESGGGLVQPGRSLRLSCAASGFTFSNAWMHWVRQAPGKGLEWVAQIKDKGNAYAAYYAPSVKGRFTISRDDSKNSIYLQMNSLKTEDTAVYYCHYVHYASASTVLPAFGVDAWGQGTTVTVSS

SEQ ID NO: 62 - protein, 5 aa, Artificial Sequence
  An artificially synthesized sequence
NAWMH

SEQ ID NO: 63 - protein, 19 aa, Artificial Sequence
  An artificially synthesized sequence
QIKDKGNAYAAYYAPSVKG

SEQ ID NO: 64 - protein, 17 aa, Artificial Sequence
  An artificially synthesized sequence
VHYASASTVLPAFGVDA

SEQ ID NO: 65 - protein, 212 aa, Artificial Sequence
  An artificially synthesized sequence
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMDYKDDDDK

SEQ ID NO: 66 - protein, 189 aa, Artificial Sequence
  An artificially synthesized sequence
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQHHHHHHGGGGSGLNDIFEAQKIEWHE

SEQ ID NO: 67 - protein, 683 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 68 - protein, 222 aa, Artificial Sequence
  An artificially synthesized sequence
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 456 aa, Artificial Sequence
  An artificially synthesized sequence
QVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 70 - protein, 219 aa, Artificial Sequence
  An artificially synthesized sequence
DIVMTQSPLSLPVTPGEPASISCQPSQEVVHMNRNTYLHWYQQKPGQAPRLLIYKVSNRFPGVPDRFSGSGSGTDFTLKISRVEAEDVGVYYCAQGTSHPFTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 678 aa, Artificial Sequence
  An artificially synthesized sequence
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 72 - protein, 223 aa, Artificial Sequence
  An artificially synthesized sequence
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 683 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 74 - protein, 456 aa, Artificial Sequence
  An artificially synthesized sequence
QVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 75 - protein, 683 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFTFSNAWMHWVRQAPGKGLEWVAQIKDKGNAYAAYYAPSVKGRFTISRDDSKNSIYLQMNSLKTEDTAVYYCRYVHYASASTLLPAFGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 76 - protein, 456 aa, Artificial Sequence
  An artificially synthesized sequence
QVQLVESGGGLVQPGRSLRLSCAASGFTFSNAWMHWVRQAPGKGLEWVAQIKDKGNAYAAYYAPSVKGRFTISRDDSKNSIYLQMNSLKTEDTAVYYCRYVHYASASTLLPAFGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 77 - protein, 219 aa, Artificial Sequence
  An artificially synthesized sequence
DIVMTQSPLSLPVTPGEPASISCQASQELVHMNRNTYLHWYQQKPGQAPRLLIYKVSNRFPGVPDRFSGSGSGTDFTLKISRVEAEDVGVYYCAQGTSVPFTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 683 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNTWFHWVRQAPGKGLEWVAQIKDYYNDYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 79 - protein, 456 aa, Artificial Sequence
  An artificially synthesized sequence
QVQLVESGGGLVQPGRSLRLSCAASGFKFSNTWFHWVRQAPGKGLEWVAQIKDYYNDYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRRGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 80 - protein, 683 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 81 - protein, 456 aa, Artificial Sequence
  An artificially synthesized sequence
QVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSCSLGTQTYICNVNHKPSNTKVDEKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 82 - protein, 219 aa, Artificial Sequence; identical to SEQ ID NO: 70
  An artificially synthesized sequence

SEQ ID NO: 83 - protein, 230 aa, Artificial Sequence
  An artificially synthesized sequence
EPKSSDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 84 - protein, 683 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVESGGGLVQPGRSLRLSCAASGFKFSNVWFHWVRQAPGKGLEWVAQIKDYYNAYAAYYAPSVKGRFTISRDDSKNSIYLQMNSLKTEDTAVYYCHYVHYASASTLLPAEGVDAWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 85 - protein, 112 aa, Artificial Sequence
  An artificially synthesized sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 86 - protein, 15 aa, Artificial Sequence
  An artificially synthesized sequence
QDGNEEMGGITQTPY

SEQ ID NO: 87 - protein, 112 aa, Artificial Sequence
  An artificially synthesized sequence
DIVMTQSPMSLPVTPGEPASISCQSSESLLHANRNTYLHWYQQKPGQAPRLLIYKVSNRFNGVPDRFSGSGSGTDFTLKISRVEAEDVGVYYCAQGTANPYTFGQGTKLEIK

SEQ ID NO: 88 - protein, 112 aa, Artificial Sequence
  An artificially synthesized sequence
DIVMTQSPLSLPVTPGEPASISCAASESLLHTNRNTYLHWYQQKPGQAPRLLIYKVSNRFSGVPDRFSGSGSGTDFTLKISRVEAEDVGVYYCAQGTQSPFTFGQGTKLEIK

SEQ ID NO: 89 - protein, 112 aa, Artificial Sequence
  An artificially synthesized sequence
DIVMTQSPLSLPVTPGEPASISCTSSQSLLHANRNTYLHWYQQKPGQAPRLLIYKVSNRFSGVPDRFSGSGSGTDFTLKISRVEAEDVGVYYCAQGTSAPFTFGQGTKLEIK

SEQ ID NO: 90 - protein, 399 aa, Artificial Sequence
  An artificially synthesized sequence
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 91 - protein, 270 aa, Artificial Sequence
  An artificially synthesized sequence
MKSLFKVTLLATTMAVALHAPITFAAEAAKPATAADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 92 - protein, 163 aa, Artificial Sequence
  An artificially synthesized sequence
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQ

SEQ ID NO: 93 - protein, 121 aa, Artificial Sequence [sequence omitted]

SEQ ID NO: 94 - protein, 109 aa, Artificial Sequence [sequence omitted]

SEQ ID NO: 95 - protein, 373 aa, Artificial Sequence
  An artificially synthesized sequence
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGGSGENLYFQGSGGGLNDIFEAQKIEWHE

SEQ ID NO: 96 - protein, 323 aa, Artificial Sequence
  An artificially synthesized sequence
FKIPIEELEDRVFVNCNTSITWVEGTVGTLLSDITRLDLGKRILDPRGIYRCNGTDIYKDKESTVQVHYRMCQSCVELDDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 97 - protein, 128 aa, Artificial Sequence
  An artificially synthesized sequence
QVQLVESGGGLVQPGRSLRLSCAASGFTFSNAWMHWVRQAPGKGLEWVAQIKDKGNAYAAYYAPSVKGRFTISRDDSKNSIYLQMNSLKTEDTAVYYCHYVHYASAAGGLPGFGVDAWGQGTTVTVSS

SEQ ID NO: 98 - protein, 128 aa, Artificial Sequence
  An artificially synthesized sequence
QVQLVESGGGLVQPGRSLRLSCAASGFTFSNAWMHWVRQAPGKGLEWVAQIKDRSQLYAAYYAPSVKGRFTISRDDSKNSIYLQMNSLKTEDTAVYYCHYVHYASASTVLGAYGVDAWGQGTTVTVSS

SEQ ID NO: 99 - protein, 128 aa, Artificial Sequence
  An artificially synthesized sequence
QVQLVESGGGLVQPGRSLRLSCAASGFTFSNAWMHWVRQAPGKGLEWVAQIKDRANSYNAYYAPSVKGRFTISRDDSKNSIYLQMNSLKTEDTAVYYCHYVHYSAASTLLPSFGVDAWGQGTTVTVSS

SEQ ID NO: 100 - protein, 128 aa, Artificial Sequence
  An artificially synthesized sequence
QVQLVESGGGLVQPGRSLRLSCAASGFTFSNAWMHWVRQAPGKGLEWVAQIKDKQNLYNAYYAESVKGRFTISRDDSKNSIYLQMNSLKTEDTAVYYCHYVHYASASTVLPAFGVDAWGQGTTVTVSS

SEQ ID NO: 101 - protein, 128 aa, Artificial Sequence
  An artificially synthesized sequence
QVQLVESGGGLVQPGRSLRLSCAASGFTFSIAWMHWVRQAPGKGLEWVAQIKDKVNGYTAYYAESVKGRFTISRDDSKNSIYLQMNSLKTEDTAVYYCRYVHYAAYYDVLGYGGVDAWGQGTTVTVSS

SEQ ID NO: 102 - protein, 128 aa, Artificial Sequence
  An artificially synthesized sequence
QVQLVESGGGLVQPGRSLRLSCAASGFTFSIAWMHWVRQAPGKGLEWVAQIKDRVNAYEAYYAPSVKGRFTISRDDSKNSIYLQMNSLKTEDTAVYYCRYVHYASYYDLLGYGGVDAWGQGTTVTVSS

SEQ ID NO: 103 - protein, 128 aa, Artificial Sequence
  An artificially synthesized sequence
QVQLVESGGGLVQPGRSLRLSCAASGFTFSNAWMHWVRQAPGKGLEWVAQIKDRGQQYNAYYAPSVKGRFTISRDDSKNSIYLQMNSLKTEDTAVYYCHYVHYASASSVLPGYGVDAWGQGTTVTVSS

SEQ ID NO: 104 - protein, 128 aa, Artificial Sequence; identical to SEQ ID NO: 61
  An artificially synthesized sequence

SEQ ID NO: 105 - protein, 128 aa, Artificial Sequence
  An artificially synthesized sequence
QVQLVESGGGLVQPGRSLRLSCAASGFTFSNAWMHWVRQAPGKGLEWVAQIKDRSNQYATYYAPSVKGRFTISRDDSKNSIYLQMNSLKTEDTAVYYCHYVHYASASTVLPAFGVDAWGQGTTVTVSS

SEQ ID NO: 106 - protein, 128 aa, Artificial Sequence
  An artificially synthesized sequence
QVQLVESGGGLVQPGRSLRLSCAASGFTFSNAWMHWVRQAPGKGLEWVAQIKDRGNAYNAYYAESVKGRFTISRDDSKNSIYLQMNSLKTEDTAVYYCHYVHYASASTVLPAFGVDAWGQGTTVTVSS

SEQ ID NO: 107 - protein, 128 aa, Artificial Sequence
  An artificially synthesized sequence
QVQLVESGGGLVQPGRSLRLSCAASGFTFSNAWMHWVRQAPGKGLEWVAQIKDRSNAYAAYYAPSVKGRFTISRDDSKNSIYLQMNSLKTEDTAVYYCHYVHYASASTVLPAFGVDAWGQGTTVTVSS

SEQ ID NO: 108 - protein, 128 aa, Artificial Sequence
  An artificially synthesized sequence
QVQLVESGGGLVQPGRSLRLSCAASGFTFSNAWMHWVRQAPGKGLEWVAQIKDKQSGYNTYYAPSVKGRFTISRDDSKNSIYLQMNSLKTEDTAVYYCHYVHYASASTVLPAFGVDAWGQGTTVTVSS

SEQ ID NO: 109 - protein, 128 aa, Artificial Sequence
  An artificially synthesized sequence
QVQLVESGGGLVQPGRSLRLSCAASGFTFSNAWMHWVRQAPGKGLEWVAQIKDRSNNYATYYAESVKGRFTISRDDSKNSIYLQMNSLKTEDTAVYYCHYVHYASASTVLPAFGVDAWGQGTTVTVSS

SEQ ID NO: 110 - protein, 128 aa, Artificial Sequence
  An artificially synthesized sequence
QVQLVESGGGLVQPGRSLRLSCAASGFTFSNAWMHWVRQAPGKGLEWVAQIKDRSQLYAAYYAPSVKGRFTISRDDSKNSIYLQMNSLKTEDTAVYYCHYVHYASASTVLPAFGVDAWGQGTTVTVSS

SEQ ID NO: 111 - protein, 128 aa, Artificial Sequence
  An artificially synthesized sequence
QVQLVESGGGLVQPGRSLRLSCAASGFTFSNAWMHWVRQAPGKGLEWVAQIKDRSNQYATYYAPSVKGRFTISRDDSKNSIYLQMNSLKTEDTAVYYCHYVHYSAASTLLPSFGVDAWGQGTTVTVSS

SEQ ID NO: 112 - protein, 126 aa, Artificial Sequence
  An artificially synthesized sequence
QVQLVESGGGLVQPGRSLRLSCAASGFTFSNAWMHWVRQAPGKGLEWVAQIKDRQQGYATYYAPSVKGRFTISRDDSKNSIYLQMNSLKTEDTAVYYCRFVHYHLAGYGYYGVDAWGQGTTVTVSS

SEQ ID NO: 113 - protein, 127 aa, Artificial Sequence
  An artificially synthesized sequence
QVQLVESGGGLVQPGRSLRLSCAASGFTFSNAWMHWVRQAPGKGLEWVAQIKDRGNAYNAYYAESVKGRFTISRDDSKNSIYLQMNSLKTEDTAVYYCRFVHYRHPLLHIQYGVDAWGQGTTVTVSS

SEQ ID NO: 114 - protein, 128 aa, Artificial Sequence
  An artificially synthesized sequence
QVQLVESGGGLVQPGRSLRLSCAASGFTFSNAWMHWVRQAPGKGLEWIAQIKDRSNQYATYYAPSVKGRFTISRDDSKNSIYLQMNSLKTEDTAVYYCHYVHYAQASSLLPSFGVDAWGQGTTVTVSS

SEQ ID NO: 115 - protein, 128 aa, Artificial Sequence
  An artificially synthesized sequence
QVQLVESGGGLVQPGRSLRLSCAASGFTFSNAWMHWVRQAPGKGLEWVAQIKDKGNLYAAYYAPSVKGRFTISRDDSKNSIYLQMNSLKTEDTAVYYCHYVHYASAGGGLPGFGVDAWGQGTTVTVSS

SEQ ID NO: 116 - protein, 128 aa, Artificial Sequence
  An artificially synthesized sequence
QVQLVESGGGLVQPGRSLRLSCAASGFTFSNAWMHWVRQAPGKGLEWVAQIKDKGNLYAAYYAPSVKGRFTISRDDSKNSIYLQMNSLKTEDTAVYYCHYVHYASAGGGLSAYGVDAWGQGTTVTVSS

SEQ ID NO: 117 - protein, 128 aa, Artificial Sequence
  An artificially synthesized sequence
QVQLVESGGGLVQPGRSLRLSCAASGFTFSSAWMHWVRQAPGKGLEWVAQIKDRASAYNAYYAESVKGRFTISRDDSKNSIYLQMNSLKTEDTAVYYCRYVHYPSYVSFLPYYGVDAWGQGTTVTVSS

SEQ ID NO: 118 - protein, 128 aa, Artificial Sequence
  An artificially synthesized sequence
QVQLVESGGGLVQPGRSLRLSCAASGFTFSNAWMHWVRQAPGKGLEWIAQIKDRGNNYNNYYAPSVKGRFTISRDDSKNSIYLQMNSLKTEDTAVYYCHYVHYATASTLLGAYGVDAWGQGTTVTVSS

SEQ ID NO: 119 - protein, 128 aa, Artificial Sequence
  An artificially synthesized sequence
QVQLVESGGGLVQPGRSLRLSCAASGFTFSNAWMHWVRQAPGKGLEWVAQIKDRSNQYATYYAPSVKGRFTISRDDSKNSIYLQMNSLKTEDTAVYYCHYVHYAQASTVLPAFGVDAWGQGTTVTVSS

SEQ ID NO: 120 - protein, 128 aa, Artificial Sequence
  An artificially synthesized sequence
QVQLVESGGGLVQPGRSLRLSCAASGFTFSNAWMHWVRQAPGKGLEWVAQIKDRSSSYLTYYAESVKGRFTISRDDSKNSIYLQMNSLKTEDTAVYYCHYVHYASSSTLLPSFGVDAWGQGTTVTVSS

SEQ ID NO: 121 - protein, 128 aa, Artificial Sequence
  An artificially synthesized sequence
QVQLVESGGGLVQPGRSLRLSCAASGFTFSNAWMHWVRQAPGKGLEWVAQIKDKGNAYAAYYAPSVKGRFTISRDDSKNSIYLQMNSLKTEDTAVYYCHYVHYSAASTVLPAFGVDAWGQGTTVTVSS

SEQ ID NO: 122 - protein, 128 aa, Artificial Sequence
  An artificially synthesized sequence
QVQLVESGGGLVQPGRSLRLSCAASGFTISSAWMHWVRQAPGKGLEWVAQIKDRANGYAAYYAPSVKGRFTISRDDSKNSIYLQMNSLKTEDTAVYYCRYVHYATAYDGFYGFGVDAWGQGTTVTVSS

SEQ ID NO: 123 - protein, 112 aa, Artificial Sequence
  An artificially synthesized sequence
DIVMTQSPLSLPVTPGEPASISCRSSQELVHTNRHTYLHWYQQKPGQAPRLLIYKVSNRFPGVPDRFSGSGSGTDFTLKISRVEAEDVGVYYCAQGTQVPFTFGQGTKLEIK

SEQ ID NO: 124 - protein, 112 aa, Artificial Sequence; identical to SEQ ID NO: 48
  An artificially synthesized sequence

SEQ ID NO: 125 - protein, 112 aa, Artificial Sequence
  An artificially synthesized sequence
DIVMTQSPLSLPVTPGEPASISCSASESLLHNNRHTYLHWYQQKPGQAPRLLIYRVSNRFNGVPDRFSGSGSGTDFTLKISRVEAEDVGVYYCGQGTQVPFTFGQGTKLEIK

SEQ ID NO: 126 - protein, 112 aa, Artificial Sequence
  An artificially synthesized sequence
DIVMTQSPLSLPVTPGEPASISCRTSQELVHINRYIFLHWYQQKPGQAPRLLIYKVYNRFQGVPDRFSGSGSGTDFTLKISRVEAEDVGVYYCAQGTSVPYTFGQGTKLEIK

SEQ ID NO: 127 - protein, 112 aa, Artificial Sequence
  An artificially synthesized sequence
DIVMTQSPLSLPVTPGEPASISCAASEELVHINRYIFLHWYQQKPGQAPRLLIYKVSNRFIGVPDRFSGSGSGTDFTLKISRVEAEDVGVYYCAQGSQVPFTFGQGTKLEIK

SEQ ID NO: 128 - protein, 112 aa, Artificial Sequence
  An artificially synthesized sequence
DIVMTQSPLSLPVTPGEPASISCSTSEELLHINRFIFLHWYQQKPGQAPRLLIYKVANRFMGVPDRFSGSGSGTDFTLKISRVEAEDVGVYYCAQGSQVPFTFGQGTKLEIK

SEQ ID NO: 129 - protein, 112 aa, Artificial Sequence
  An artificially synthesized sequence
DIVMTQSPLSLPVTPGEPASISCSSSQELVHANRQIYLHWYQQKPGQAPRLLIYKVANRFPGVPDRFSGSGSGTDFTLKISRVEAEDVGVYYCAQGTQVPFTFGQGTKLEIK

SEQ ID NO: 130 - protein, 112 aa, Artificial Sequence
  An artificially synthesized sequence
DIVMTQSPLSLPVTPGEPASISCTASQELVHINRFIFLHWYQQKPGQAPRLLIYKVSNRFIGVPDRFSGSGSGTDFTLKISRVEAEDVGVYYCAQGSQVPFTFGQGTKLEIK

SEQ ID NO: 131 - protein, 112 aa, Artificial Sequence
  An artificially synthesized sequence
DIVMTQSPLSLPVTPGEPASISCQSSESLVHVNRHTYLHWYQQKPGQAPRLLIYKVYNRFPGVPDRFSGSGSGTDFTLKISRVEAEDVGVYYCAQGTSVPFTFGQGTKLEIK

SEQ ID NO: 132 - protein, 112 aa, Artificial Sequence
  An artificially synthesized sequence
DIVMTQSPLSLPVTPGEPASISCSASEELVHINRYIFLHWYQQKPGQAPRLLIYKVYNRFMGVPDRFSGSGSGTDFTLKISRVEAEDVGVYYCGQGSSVPFTFGQGTKLEIK

SEQ ID NO: 133 - protein, 112 aa, Artificial Sequence
  An artificially synthesized sequence
DIVMTQSPLSLPVTPGEPASISCRTSEELLHINRFTFLHWYQQKPGQAPRLLIYKVSNRFMGVPDRFSGSGSGTDFTLKISRVEAEDVGVYYCAQGSAVPFTFGQGTKLEIK

SEQ ID NO: 134 - protein, 112 aa, Artificial Sequence
  An artificially synthesized sequence
DIVMTQSPLSLPVTPGEPASISCTSDQELVHMNRHTYLHWYQQKPGQAPRLLIYKVYNRFPGVPDRFSGSGSGTDFTLKISRVEAEDVGVYYCAQGTSVPFTFGQGTKLEIK

SEQ ID NO: 135 - protein, 112 aa, Artificial Sequence
  An artificially synthesized sequence
DIVMTQSPLSLPVTPGEPASISCRTSEELLHINRYIFLHWYQQKPGQAPRLLIYKVQNRFSGVPDRFSGSGSGTDFTLKISRVEAEDVGVYYCAQGSAVPFTFGQGTKLEIK

SEQ ID NO: 136 - protein, 112 aa, Artificial Sequence
  An artificially synthesized sequence
DIVMTQSPLSLPVTPGEPASISCYASEELLHINRHIYLHWYQQKPGQAPRLLIYKVYNRFNGVPDRFSGSGSGTDFTLKISRVEAEDVGVYYCAQGSSVPFTFGQGTKLEIK

SEQ ID NO: 137 - protein, 112 aa, Artificial Sequence
  An artificially synthesized sequence
DIVMTQSPLSLPVTPGEPASISCRASEELLHINRHIFLHWYQQKPGQAPRLLIYKVYNRFTGVPDRFSGSGSGTDFTLKISRVEAEDVGVYYCAQGTSVPFTFGQGTKLEIK

SEQ ID NO: 138 - protein, 112 aa, Artificial Sequence
  An artificially synthesized sequence
DIVMTQSPLSLPVTPGEPASISCQTSEELVHINRFIFLHWYQQKPGQAPRLLIYKVSNRFSGVPDRFSGSGSGTDFTLKISRVEAEDVGVYYCAQGTSVPFTFGQGTKLEIK

SEQ ID NO: 139 - protein, 115 aa, Artificial Sequence
  An artificially synthesized sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSS

SEQ ID NO: 140 - protein, 112 aa, Artificial Sequence
  An artificially synthesized sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCSQNTHVPPTFGQGTKLEIK

SEQ ID NO: 141 - protein, 450 aa, Artificial Sequence
  An artificially synthesized sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCSQNTHVPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 142 - protein, 449 aa, Artificial Sequence
  An artificially synthesized sequence
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 143 - protein, 222 aa, Artificial Sequence
  An artificially synthesized sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - protein, 216 aa, Artificial Sequence
  An artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 122 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSS

SEQ ID NO: 146 - protein, 112 aa, Artificial Sequence; identical to SEQ ID NO: 85
  An artificially synthesized sequence

SEQ ID NO: 147 - protein, 22 aa, Artificial Sequence
  An artificially synthesized sequence
LQDPCSNCPAGTFCDNNRNQIC

SEQ ID NO: 148 - protein, 41 aa, Artificial Sequence
  An artificially synthesized sequence
SPCPPNSFSSAGGQRTCDICRQCKGVFRTRKECSSTSNAEC

SEQ ID NO: 149 - protein, 31 aa, Artificial Sequence
  An artificially synthesized sequence
DCTPGFHCLGAGCSMCEQDCKQGQELTKKGC

SEQ ID NO: 150 - protein, 69 aa, Artificial Sequence
  An artificially synthesized sequence
KDCCFGTFNDQKRGICRPWTNCSLDGKSVLVNGTKERDVVCGPSPADLSPGASSVTPPAPAREPGHSPQ

SEQ ID NO: 151 - protein, 94 aa, Artificial Sequence
  An artificially synthesized sequence
LQDPCSNCPAGTFCDNNRNQICSPCPPNSFSSAGGQRTCDICRQCKGVFRTRKECSSTSNAECDCTPGFHCLGAGCSMCEQDCKQGQELTKKGC

SEQ ID NO: 152 - protein, 63 aa, Artificial Sequence
  An artificially synthesized sequence
LQDPCSNCPAGTFCDNNRNQICSPCPPNSFSSAGGQRTCDICRQCKGVFRTRKECSSTSNAEC

SEQ ID NO: 153 - protein, 141 aa, Artificial Sequence
  An artificially synthesized sequence
SPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 154 - protein, 72 aa, Artificial Sequence
  An artificially synthesized sequence
SPCPPNSFSSAGGQRTCDICRQCKGVFRTRKECSSTSNAECDCTPGFHCLGAGCSMCEQDCKQGQELTKKGC

SEQ ID NO: 155 - protein, 100 aa, Artificial Sequence
  An artificially synthesized sequence
DCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 156 - protein, 336 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 157 - protein, 107 aa, Artificial Sequence [sequence omitted]

SEQ ID NO: 158 - protein, 112 aa, Artificial Sequence
  An artificially synthesized sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 159 - protein, 15 aa, Artificial Sequence
  An artificially synthesized sequence
QDGNEEMGGITQTPY

SEQ ID NO: 160 - protein, 128 aa, Artificial Sequence
  An artificially synthesized sequence
QVQLVESGGGLVQPGRSLRLSCAASGFTFSNAWMHWVRQAPGKGLEWVAQIKDKSNNYATYYAESVKGRFTISRDDSKNSIYLQMNSLKTEDTAVYYCRYVHYGAGGSGGSYYGVDAWGQGTTVTVSS

SEQ ID NO: 161 - protein, 112 aa, Artificial Sequence; identical to SEQ ID NO: 85
  An artificially synthesized sequence

SEQ ID NO: 162 - protein, 122 aa, Artificial Sequence; identical to SEQ ID NO: 145
  An artificially synthesized sequence

SEQ ID NO: 163 - protein, 112 aa, Artificial Sequence
  An artificially synthesized sequence
DVVMTQTPVSMSVSLGGQVSISCRSSQSLVHNNGNTYVSWYIQKPSQSPQLLIYKVSNRFSGISDRFSGSGSGTDFTLKISRVEPDDLGVYYCGQGTQDPYTFGAGTKLELK

SEQ ID NO: 164 - protein, 119 aa, Artificial Sequence
  An artificially synthesized sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 165 - protein, 107 aa, Artificial Sequence
  An artificially synthesized sequence
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 166 - protein, 447 aa, Artificial Sequence
  An artificially synthesized sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 167 - protein, 447 aa, Artificial Sequence
  An artificially synthesized sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 168 - protein, 447 aa, Artificial Sequence
  An artificially synthesized sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 169 - protein, 445 aa, Artificial Sequence
  An artificially synthesized sequence
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNRYTQKSLSLSPHHHHHHHH

SEQ ID NO: 170 - protein, 226 aa, Artificial Sequence
  An artificially synthesized sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSARTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 458 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 172 - protein, 219 aa, Artificial Sequence
  An artificially synthesized sequence
DVVMTQTPVSMSVSLGGQVSISCRSSQSLVHNNGNTYVSWYIQKPSQSPQLLIYKVSNRFSGISDRFSGSGSGTDFTLKISRVEPDDLGVYYCGQGTQDPYTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 173 - protein, 461 aa, Artificial Sequence
  An artificially synthesized sequence
EVQLVETGGSLVQPGKSLKLTCATSGFTFSNAWMHWVRQSPEKQLEWVAQIKAKGGSSNNYATYYAESVKGRFTISRDDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 174 - protein, 464 aa, Artificial Sequence
  An artificially synthesized sequence
EVQLVETGGSLVQPGKSLKLTCATSGFTFSNAWMHWVRQSPEKQLEWVAQIKAKGGSGGSSNNYATYYAESVKGRFTISRDDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 175 - protein, 6 aa, Artificial Sequence
  An artificially synthesized sequence
GGSGGS

SEQ ID NO: 176 - protein, 467 aa, Artificial Sequence
  An artificially synthesized sequence
EVQLVETGGSLVQPGKSLKLTCATSGFTFSNAWMHWVRQSPEKQLEWVAQIKAKGGSGGSGGSSNNYATYYAESVKGRFTISRDDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 177 - protein, 9 aa, Artificial Sequence
  An artificially synthesized sequence
GGSGGSGGS

SEQ ID NO: 178 - protein, 461 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDGGSDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 179 - protein, 464 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDGGSGGSDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 180 - protein, 467 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDGGSGGSGGSDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 181 - protein, 461 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAGGSYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 182 - protein, 464 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAGGSGGSYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 183 - protein, 467 aa, Artificial Sequence
  An artificially synthesized sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAGGSGGSGGSYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 184 - protein, 122 aa, Artificial Sequence
  An artificially synthesized sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSS

SEQ ID NO: 185 - protein, 112 aa, Artificial Sequence; identical to SEQ ID NO: 85
  An artificially synthesized sequence

SEQ ID NO: 186 - protein, 336 aa, Artificial Sequence; identical to SEQ ID NO: 156
  An artificially synthesized sequence

SEQ ID NO: 187 - protein, 107 aa, Artificial Sequence [sequence omitted]

SEQ ID NO: 188 - protein, 230 aa, Artificial Sequence
  An artificially synthesized sequence
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNRYTQKSLSLSP

SEQ ID NO: 189 - protein, 449 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 214 aa, Artificial Sequence [sequence omitted]

SEQ ID NO: 191 - protein, 7 aa, Artificial Sequence
  An artificially synthesized sequence
GGSGGGS

SEQ ID NO: 192 - protein, 8 aa, Artificial Sequence
  An artificially synthesized sequence
GGGSGGGS

SEQ ID NO: 193 - protein, 458 aa, Artificial Sequence
  An artificially synthesized sequence
QVQLVESGGGLVQPGRSLRLSCAASGFTFSNAWMHWVRQAPGKGLEWVAQIKDKSNNYATYYAESVKGRFTISRDDSKNSIYLQMNSLKTEDTAVYYCRYVHYAAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 194 - protein, 28 aa, Artificial Sequence
  An artificially synthesized sequence
  misc_feature (1)..(1): Xaa can be any naturally occurring amino acid
XDGNEEMGGITQTPYKVSISGTTVILTC

SEQ ID NO: 195 - protein, 163 aa, Artificial Sequence
  An artificially synthesized sequence
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 196 - DNA, 18 bp, Artificial Sequence
  An artificially synthesized sequence
gcgtcacactttgctatg

SEQ ID NO: 197 - DNA, 21 bp, Artificial Sequence
  An artificially synthesized sequence
tgagttccacgacaccgtcac

SEQ ID NO: 198 - DNA, 55 bp, Artificial Sequence
  An artificially synthesized sequence
gttattactcgcggcccagccggccatggcggatatcgtgatgacccagtctccg

SEQ ID NO: 199 - DNA, 27 bp, Artificial Sequence
  An artificially synthesized sequence
tttaatttccagtttggtaccttgacc

SEQ ID NO: 200 - protein, 8 aa, Artificial Sequence
  An artificially synthesized sequence
DYKDDDDK

SEQ ID NO: 201 - protein, 447 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 202 - protein, 214 aa, Artificial Sequence [sequence omitted]

SEQ ID NO: 203 - protein, 119 aa, Artificial Sequence [sequence omitted]

SEQ ID NO: 204 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 205 - protein, 107 aa, Artificial Sequence [sequence omitted]

SEQ ID NO: 206 - protein, 107 aa, Artificial Sequence [sequence omitted]

SEQ ID NO: 207 - protein, 119 aa, Artificial Sequence
  An artificially synthesized sequence
QVQLCESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 208 - protein, 119 aa, Artificial Sequence
  An artificially synthesized sequence
QVQLQCSGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 209 - protein, 119 aa, Artificial Sequence
  An artificially synthesized sequence
QVQLQECGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 210 - protein, 119 aa, Artificial Sequence
  An artificially synthesized sequence
QVQLQESCPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 211 - protein, 119 aa, Artificial Sequence
  An artificially synthesized sequence
QVQLQESGCGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 212 - protein, 119 aa, Artificial Sequence
  An artificially synthesized sequence
QVQLQESGPCLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 213 - protein, 119 aa, Artificial Sequence
  An artificially synthesized sequence
QVQLQESGPGCVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 214 - protein, 119 aa, Artificial Sequence
  An artificially synthesized sequence
QVQLQESGPGLCRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 215 - protein, 119 aa, Artificial Sequence
  An artificially synthesized sequence
QVQLQESGPGLVCPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 216 - protein, 119 aa, Artificial Sequence
  An artificially synthesized sequence
QVQLQESGPGLVRCSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 217 - protein, 119 aa, Artificial Sequence
  An artificially synthesized sequence
QVQLQESGPGLVRPCQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 218 - protein, 119 aa, Artificial Sequence
  An artificially synthesized sequence
QVQLQESGPGLVRPSCTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 219 - protein, 119 aa, Artificial Sequence
  An artificially synthesized sequence
QVQLQESGPGLVRPSQCLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 220 - protein, 119 aa, Artificial Sequence
  An artificially synthesized sequence
QVQLQESGPGLVRPSQTCSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 221 - protein, 119 aa, Artificial Sequence
  An artificially synthesized sequence
QVQLQESGPGLVRPSQTLCLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 222 - protein, 119 aa, Artificial Sequence
  An artificially synthesized sequence
QVQLQESGPGLVRPSQTLSCTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 223 - protein, 119 aa, Artificial Sequence
  An artificially synthesized sequence
QVQLQESGPGLVRPSQTLSLCCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 224 - protein, 119 aa, Artificial Sequence
  An artificially synthesized sequence
QVQLQESGPGLVRPSQTLSLTCCVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 225 - protein, 119 aa, Artificial Sequence
  An artificially synthesized sequence
QVQLQESGPGLVRPSQTLSLTCTVCGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 226 - protein, 119 aa, Artificial Sequence
  An artificially synthesized sequence
QVQLQESGPGLVRPSQTLSLTCTVSCYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 227 - protein, 119 aa, Artificial Sequence
  An artificially synthesized sequence
QVQLQESGPGLVRPSQTLSLTCTVSGYCITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 228 - protein, 119 aa, Artificial Sequence
  An artificially synthesized sequence
QVQLQESGPGLVRPSQTLSLTCTVSGYSICSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 229 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSCVTMLRDTSKNQFSLRLSSVTAADTAVYYCARSLARTTAMDYWGQGSLVTVSS

SEQ ID NO: 230 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRCTMLRDTSKNQFSLRLSSVTAADTAVYYCARSLARTTAMDYWGQGSLVTVSS

SEQ ID NO: 231 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVCMLRDTSKNQFSLRLSSVTAADTAVYYCARSLARTTAMDYWGQGSLVTVSS

SEQ ID NO: 232 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMCRDTSKNQFSLRLSSVTAADTAVYYCARSLARTTAMDYWGQGSLVTVSS

SEQ ID NO: 233 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRCTSKNQFSLRLSSVTAADTAVYYCARSLARTTAMDYWGQGSLVTVSS

SEQ ID NO: 234 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDCSKNQFSLRLSSVTAADTAVYYCARSLARTTAMDYWGQGSLVTVSS

SEQ ID NO: 235 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTCKNQFSLRLSSVTAADTAVYYCARSLARTTAMDYWGQGSLVTVSS

SEQ ID NO: 236 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSCNQFSLRLSSVTAADTAVYYCARSLARTTAMDYWGQGSLVTVSS

SEQ ID NO: 237 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKCQFSLRLSSVTAADTAVYYCARSLARTTAMDYWGQGSLVTVSS

SEQ ID NO: 238 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNCFSLRLSSVTAADTAVYYCARSLARTTAMDYWGQGSLVTVSS

SEQ ID NO: 239 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFCLRLSSVTAADTAVYYCARSLARTTAMDYWGQGSLVTVSS

SEQ ID NO: 240 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSCRLSSVTAADTAVYYCARSLARTTAMDYWGQGSLVTVSS

SEQ ID NO: 241 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLCLSSVTAADTAVYYCARSLARTTAMDYWGQGSLVTVSS

SEQ ID NO: 242 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRCSSVTAADTAVYYCARSLARTTAMDYWGQGSLVTVSS

SEQ ID NO: 243 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLCSVTAADTAVYYCARSLARTTAMDYWGQGSLVTVSS

SEQ ID NO: 244 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSCVTAADTAVYYCARSLARTTAMDYWGQGSLVTVSS

SEQ ID NO: 245 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSCTAADTAVYYCARSLARTTAMDYWGQGSLVTVSS

SEQ ID NO: 246 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVCS

SEQ ID NO: 247 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSC

SEQ ID NO: 248 - protein, 119 aa, Artificial Sequence
  An artificially synthesized sequence
QVQLQESGPGLVRPSQTLSLTCTVSGYSITCDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 249 - protein, 119 aa, Artificial Sequence
  An artificially synthesized sequence
QVQLQESGPGLVRPSQTLSLTCTVSGYSITSDHACSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 250 - protein, 119 aa, Artificial Sequence
  An artificially synthesized sequence
QVQLQESGPGLVRPSQTLSLTCTVSGYSITSDHAWCWVRQPPGRGLEWIGYISYSGITTYNPSLKSRVTMLRDTSKNQFSLRLSSVTAADTAVYYCARSLARTTAMDYWGQGSLVTVSS

SEQ ID NO: 251 - protein, 119 aa, Artificial Sequence
  An artificially synthesized sequence
QVQLQESGPGLVRPSQTLSLTCTVSGYSITSDHAWSWVRQPPGRGLEWIGCISYSGITTYNPSLKSRVTMLRDTSKNQFSLRLSSVTAADTAVYYCARSLARTTAMDYWGQGSLVTVSS

SEQ ID NO: 252 - protein, 119 aa, Artificial Sequence
  An artificially synthesized sequence
QVQLQESGPGLVRPSQTLSLTCTVSGYSITSDHAWSWVRQPPGRGLEWIGYCSYSGITTYNPSLKSRVTMLRDTSKNQFSLRLSSVTAADTAVYYCARSLARTTAMDYWGQGSLVTVSS

SEQ ID NO: 253 - protein, 119 aa, Artificial Sequence
  An artificially synthesized sequence
QVQLQESGPGLVRPSQTLSLTCTVSGYSITSDHAWSWVRQPPGRGLEWIGYICYSGITTYNPSLKSRVTMLRDTSKNQFSLRLSSVTAADTAVYYCARSLARTTAMDYWGQGSLVTVSS

SEQ ID NO: 254 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPCLKSRVTMLRDTSKNQFSLRLSSVTAADTAVYYCARSLARTTAMDYWGQGSLVTVSS

SEQ ID NO: 255 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSCKSRVTMLRDTSKNQFSLRLSSVTAADTAVYYCARSLARTTAMDYWGQGSLVTVSS

SEQ ID NO: 256 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLCSRVTMLRDTSKNQFSLRLSSVTAADTAVYYCARSLARTTAMDYWGQGSLVTVSS

SEQ ID NO: 257 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKCRVTMLRDTSKNQFSLRLSSVTAADTAVYYCARSLARTTAMDYWGQGSLVTVSS

SEQ ID NO: 258 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMCYWGQGSLVTVSS

SEQ ID NO: 259 - protein, 119 aa, Artificial Sequence
  An artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDCWGQGSLVTVSS

SEQ ID NO: 260 - protein, 328 aa, Artificial Sequence
  An artificially synthesized sequence
CSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 261 - protein, 328 aa, Artificial Sequence
  An artificially synthesized sequence
ACTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 262 - protein, 328 aa, Artificial Sequence
  An artificially synthesized sequence
ASCKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 263 - protein, 328 aa, Artificial Sequence
  An artificially synthesized sequence
ASTCGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 264 - protein, 328 aa, Artificial Sequence
  An artificially synthesized sequence
ASTKCPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 265 - protein, 328 aa, Artificial Sequence
  An artificially synthesized sequence
ASTKGCSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 266 - protein, 328 aa, Artificial Sequence
  An artificially synthesized sequence
ASTKGPCVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 267 - protein, 328 aa, Artificial Sequence
  An artificially synthesized sequence
ASTKGPSCFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 268 - protein, 328 aa, Artificial Sequence
  An artificially synthesized sequence
ASTKGPSVCPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 269 - protein, 328 aa, Artificial Sequence
  An artificially synthesized sequence
ASTKGPSVFCLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 270 - protein, 328 aa, Artificial Sequence
  An artificially synthesized sequence
ASTKGPSVFPLAPCSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 271 - protein, 328 aa, Artificial Sequence
  An artificially synthesized sequence
ASTKGPSVFPLAPSCKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 272 - protein, 328 aa, Artificial Sequence
  An artificially synthesized sequence
ASTKGPSVFPLAPSSCSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 273 - protein, 328 aa, Artificial Sequence
  An artificially synthesized sequence
ASTKGPSVFPLAPSSKCTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 274 - protein, 328 aa, Artificial Sequence
  An artificially synthesized sequence
ASTKGPSVFPLAPSSKSCSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 275 - protein, 328 aa, Artificial Sequence
  An artificially synthesized sequence
ASTKGPSVFPLAPSSKSTCGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 276 - protein, 328 aa, Artificial Sequence
  An artificially synthesized sequence
ASTKGPSVFPLAPSSKSTSCGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 277 - protein, 328 aa, Artificial Sequence
  An artificially synthesized sequence
ASTKGPSVFPLAPSSKSTSGCTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 278 - protein, 328 aa, Artificial Sequence
  An artificially synthesized sequence
ASTKGPSVFPLAPSSKSTSGGCAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 279 - protein, 328 aa, Artificial Sequence
  An artificially synthesized sequence
ASTKGPSVFPLAPSSKSTSGGTCALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 280 - protein, 328 aa, Artificial Sequence
  An artificially synthesized sequence
ASTKGPSVFPLAPSSKSTSGGTACLGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 281 - protein, 328 aa, Artificial Sequence
  An artificially synthesized sequence
ASTKGPSVFPLAPSSKSTSGGTAALGCLVKCYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 282 - protein, 328 aa, Artificial Sequence
  An artificially synthesized sequence
ASTKGPSVFPLAPSSKSTSGGTAALGCLVKDCFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 283 - protein, 328 aa, Artificial Sequence
  An artificially synthesized sequence
ASTKGPSVFPLAPSSKSTSGGTAALGCLVKDYCPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 284 - protein, 328 aa, Artificial Sequence
  An artificially synthesized sequence
ASTKGPSVFPLAPSSKSTSGGTAALGCLVKDYFCEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 285 - protein, 328 aa, Artificial Sequence
  An artificially synthesized sequence
ASTKGPSVFPLAPSSKSTSGGTAALGCLVKDYFPCPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 286 - protein, 328 aa, Artificial Sequence
  An artificially synthesized sequence
ASTKGPSVFPLAPSSKSTSGGTAALGCLVKDYFPECVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 287 - protein, 328 aa, Artificial Sequence
  An artificially synthesized sequence
ASTKGPSVFPLAPSSKSTSGGTAALGCLVKDYFPEPCTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 288 - protein, 328 aa, Artificial Sequence
  An artificially synthesized sequence
ASTKGPSVFPLAPSSKSTSGGTAALGCLVKDYFPEPVCVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 289 - protein, 328 aa, Artificial Sequence
  An artificially synthesized sequence
ASTKGPSVFPLAPSSKSTSGGTAALGCLVKDYFPEPVTCSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 290 - protein, 328 aa, Artificial Sequence
  An artificially synthesized sequence
ASTKGPSVFPLAPSSKSTSGGTAALGCLVKDYFPEPVTVCWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 291 - protein, 328 aa, Artificial Sequence
  An artificially synthesized sequence
ASTKGPSVFPLAPSSKSTSGGTAALGCLVKDYFPEPVTVSCNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 292 - protein, 328 aa, Artificial Sequence
  An artificially synthesized sequence
ASTKGPSVFPLAPSSKSTSGGTAALGCLVKDYFPEPVTVSWCSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 293 - protein, 328 aa, Artificial Sequence
  An artificially synthesized sequence
ASTKGPSVFPLAPSSKSTSGGTAALGCLVKDYFPEPVTVSWNCGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 294 - protein, 328 aa, Artificial Sequence
  An artificially synthesized sequence
ASTKGPSVFPLAPSSKSTSGGTAALGCLVKDYFPEPVTVSWNSCALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 295 - protein, 328 aa, Artificial Sequence
  An artificially synthesized sequence
ASTKGPSVFPLAPSSKSTSGGTAALGCLVKDYFPEPVTVSWNSGCLTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 296 - protein, 328 aa, Artificial Sequence
  An artificially synthesized sequence
ASTKGPSVFPLAPSSKSTSGGTAALGCLVKDYFPEPVTVSWNSGACTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 297 - protein, 328 aa, Artificial Sequence
  An artificially synthesized sequence
ASTKGPSVFPLAPSSKSTSGGTAALGCLVKDYFPEPVTVSWNSGALCSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 298 - protein, 328 aa, Artificial Sequence
  An artificially synthesized sequence
ASTKGPSVFPLAPSSKSTSGGTAALGCLVKDYFPEPVTVSWNSGALTCGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 299 - protein, 328 aa, Artificial Sequence
  An artificially synthesized sequence
ASTKGPSVFPLAPSSKSTSGGTAALGCLVKDYFPEPVTVSWNSGALTSCVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 300 - protein, 328 aa, Artificial Sequence
  An artificially synthesized sequence
ASTKGPSVFPLAPSSKSTSGGTAALGCLVKDYFPEPVTVSWNSGALTSGCHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 301 - protein, 328 aa, Artificial Sequence
  An artificially synthesized sequence
ASTKGPSVFPLAPSSKSTSGGTAALGCLVKDYFPEPVTVSWNSGALTSGVHTFPACLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 302 - protein, 328 aa, Artificial Sequence
  An artificially synthesized sequence
ASTKGPSVFPLAPSSKSTSGGTAALGCLVKDYFPEPVTVSWNSGALTSGVHTFPAVCQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 303 - protein, 328 aa, Artificial Sequence
  An artificially synthesized sequence
ASTKGPSVFPLAPSSKSTSGGTAALGCLVKDYFPEPVTVSWNSGALTSGVHTFPAVLCSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 304 - protein, 328 aa, Artificial Sequence
  An artificially synthesized sequence
ASTKGPSVFPLAPSSKSTSGGTAALGCLVKDYFPEPVTVSWNSGALTSGVHTFPAVLQCSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 305 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSCGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 306 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSCLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 307 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGCYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 308 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLCSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 309 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVCTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 310 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVCVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 311 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTCPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 312 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVCSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 313 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPCSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 314 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 315 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSCLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 316 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSCGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 317 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLCTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 318 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGCQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 319 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTCTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 320 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQCYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 321 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTCICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 322 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYCCNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 323 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICCVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 324 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNCNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 325 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVCHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 326 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNCKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 327 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHCPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 328 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKCSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 329 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPCNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 330 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSCTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 331 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNCKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 332 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTCVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 333 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKCDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 334 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVCKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 335 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDCRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 336 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKCVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 337 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRCEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 338 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVCPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 339 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVECKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 340 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPCSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 341 - protein, 328 aa, Artificial Sequence
  An artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKCCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 342 - protein, 107 aa, Artificial Sequence
  An artificially synthesized sequence
DIQMCQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 343 - protein, 107 aa, Artificial Sequence
  An artificially synthesized sequence
DIQMTCSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 344 - protein, 107 aa, Artificial Sequence
  An artificially synthesized sequence
DIQMTQCPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 345 - protein, 107 aa, Artificial Sequence
  An artificially synthesized sequence
DIQMTQSCSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 346 - protein, 107 aa, Artificial Sequence
  An artificially synthesized sequence
DIQMTQSPCSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 347 - protein, 107 aa, Artificial Sequence
  An artificially synthesized sequence
DIQMTQSPSCLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 348 - protein, 107 aa, Artificial Sequence
  An artificially synthesized sequence
DIQMTQSPSSCSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 349 - protein, 107 aa, Artificial Sequence
  An artificially synthesized sequence
DIQMTQSPSSLCASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 350 - protein, 107 aa, Artificial Sequence
  An artificially synthesized sequence
DIQMTQSPSSLSCSVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 351 - protein, 107 aa, Artificial Sequence
  An artificially synthesized sequence
DIQMTQSPSSLSACVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 352 - protein, 107 aa, Artificial Sequence
  An artificially synthesized sequence
DIQMTQSPSSLSASCGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 353 - protein, 107 aa, Artificial Sequence
  An artificially synthesized sequence
DIQMTQSPSSLSASVCDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 354 - protein, 107 aa, Artificial Sequence
  An artificially synthesized sequence
DIQMTQSPSSLSASVGCRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 355 - protein, 107 aa, Artificial Sequence
  An artificially synthesized sequence
DIQMTQSPSSLSASVGDCVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 356 - protein, 107 aa, Artificial Sequence
  An artificially synthesized sequence
DIQMTQSPSSLSASVGDRCTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 357 - protein, 107 aa, Artificial Sequence
  An artificially synthesized sequence
DIQMTQSPSSLSASVGDRVCITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 358 - protein, 107 aa, Artificial Sequence
  An artificially synthesized sequence
DIQMTQSPSSLSASVGDRVTCTCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 359 - protein, 107 aa, Artificial Sequence
  An artificially synthesized sequence
DIQMTQSPSSLSASVGDRVTICCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 360 - protein, 107 aa, Artificial Sequence
  An artificially synthesized sequence
DIQMTQSPSSLSASVGDRVTITCRASQDISSYLNWYQQKPGKAPKLLIYYTSRLHSCVPSRFSGSGSGTDFTFTISSLQPEDIATYYCQQGNTLPYTFGQGTKVEIK

SEQ ID NO: 361 - protein, 107 aa, Artificial Sequence
  An artificially synthesized sequence
DIQMTQSPSSLSASVGDRVTITCRASQDISSYLNWYQQKPGKAPKLLIYYTSRLHSGCPSRFSGSGSGTDFTFTISSLQPEDIATYYCQQGNTLPYTFGQGTKVEIK

SEQ ID NO: 362 - protein, 107 aa, Artificial Sequence
  An artificially synthesized sequence
DIQMTQSPSSLSASVGDRVTITCRASQDISSYLNWYQQKPGKAPKLLIYYTSRLHSGVCSRFSGSGSGTDFTFTISSLQPEDIATYYCQQGNTLPYTFGQGTKVEIK

SEQ ID NO: 363 - protein, 107 aa, Artificial Sequence
  An artificially synthesized sequence
DIQMTQSPSSLSASVGDRVTITCRASQDISSYLNWYQQKPGKAPKLLIYYTSRLHSGVPCRFSGSGSGTDFTFTISSLQPEDIATYYCQQGNTLPYTFGQGTKVEIK

SEQ ID NO: 364 - protein, 107 aa, Artificial Sequence
  An artificially synthesized sequence
DIQMTQSPSSLSASVGDRVTITCRASQDISSYLNWYQQKPGKAPKLLIYYTSRLHSGVPSCFSGSGSGTDFTFTISSLQPEDIATYYCQQGNTLPYTFGQGTKVEIK

SEQ ID NO: 365 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRCSGSGSGTDFTFTISSLQPEDIATYYCQQGNTLPYTFGQGTKVEIK

SEQ ID NO: 366 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFCGSGSGTDFTFTISSLQPEDIATYYCQQGNTLPYTFGQGTKVEIK

SEQ ID NO: 367 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGCGSGTDFTFTISSLQPEDIATYYCQQGNTLPYTFGQGTKVEIK

SEQ ID NO: 368 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGCGTDFTFTISSLQPEDIATYYCQQGNTLPYTFGQGTKVEIK

SEQ ID NO: 369 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSCTDFTFTISSLQPEDIATYYCQQGNTLPYTFGQGTKVEIK

SEQ ID NO: 370 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGCDFTFTISSLQPEDIATYYCQQGNTLPYTFGQGTKVEIK

SEQ ID NO: 371 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTCFTFTISSLQPEDIATYYCQQGNTLPYTFGQGTKVEIK

SEQ ID NO: 372 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFCFTISSLQPEDIATYYCQQGNTLPYTFGQGTKVEIK

SEQ ID NO: 373 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTCTISSLQPEDIATYYCQQGNTLPYTFGQGTKVEIK

SEQ ID NO: 374 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFCISSLQPEDIATYYCQQGNTLPYTFGQGTKVEIK

SEQ ID NO: 375 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTCSSLQPEDIATYYCQQGNTLPYTFGQGTKVEIK

SEQ ID NO: 376 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTICSLQPEDIATYYCQQGNTLPYTFGQGTKVEIK

SEQ ID NO: 377 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISCLQPEDIATYYCQQGNTLPYTFGQGTKVEIK

SEQ ID NO: 378 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSCQPEDIATYYCQQGNTLPYTFGQGTKVEIK

SEQ ID NO: 379 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLCPEDIATYYCQQGNTLPYTFGQGTKVEIK

SEQ ID NO: 380 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTCGQGTKVEIK

SEQ ID NO: 381 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFCQGTKVEIK

SEQ ID NO: 382 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGCGTKVEIK

SEQ ID NO: 383 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQCTKVEIK

SEQ ID NO: 384 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGCKVEIK

SEQ ID NO: 385 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTCVEIK

SEQ ID NO: 386 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKCEIK

SEQ ID NO: 387 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVCIK

SEQ ID NO: 388 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVECK

SEQ ID NO: 389 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIC

SEQ ID NO: 390 - protein, 107 aa, Artificial Sequence
  An artificially synthesized sequence
DIQMTQSPSSLSASVGDRVTITCRCSQDISSYLNWYQQKPGKAPKLLIYYTSRLHSGVPSRFSGSGSGTDFTFTISSLQPEDIATYYCQQGNTLPYTFGQGTKVEIK

SEQ ID NO: 391 - protein, 107 aa, Artificial Sequence
  An artificially synthesized sequence
DIQMTQSPSSLSASVGDRVTITCRACQDISSYLNWYQQKPGKAPKLLIYYTSRLHSGVPSRFSGSGSGTDFTFTISSLQPEDIATYYCQQGNTLPYTFGQGTKVEIK

SEQ ID NO: 392 - protein, 107 aa, Artificial Sequence
  An artificially synthesized sequence
DIQMTQSPSSLSASVGDRVTITCRASCDISSYLNWYQQKPGKAPKLLIYYTSRLHSGVPSRFSGSGSGTDFTFTISSLQPEDIATYYCQQGNTLPYTFGQGTKVEIK

SEQ ID NO: 393 - protein, 107 aa, Artificial Sequence
  An artificially synthesized sequence
DIQMTQSPSSLSASVGDRVTITCRASQDISSCLNWYQQKPGKAPKLLIYYTSRLHSGVPSRFSGSGSGTDFTFTISSLQPEDIATYYCQQGNTLPYTFGQGTKVEIK

SEQ ID NO: 394 - protein, 107 aa, Artificial Sequence
  An artificially synthesized sequence
DIQMTQSPSSLSASVGDRVTITCRASQDISSYCNWYQQKPGKAPKLLIYYTSRLHSGVPSRFSGSGSGTDFTFTISSLQPEDIATYYCQQGNTLPYTFGQGTKVEIK

SEQ ID NO: 395 - protein, 107 aa, Artificial Sequence
  An artificially synthesized sequence
DIQMTQSPSSLSASVGDRVTITCRASQDISSYLCWYQQKPGKAPKLLIYYTSRLHSGVPSRFSGSGSGTDFTFTISSLQPEDIATYYCQQGNTLPYTFGQGTKVEIK

SEQ ID NO: 396 - protein, 107 aa, Artificial Sequence
  An artificially synthesized sequence
DIQMTQSPSSLSASVGDRVTITCRASQDISSYLNWYQQKPGKAPKLLIYCTSRLHSGVPSRFSGSGSGTDFTFTISSLQPEDIATYYCQQGNTLPYTFGQGTKVEIK

SEQ ID NO: 397 - protein, 107 aa, Artificial Sequence
  An artificially synthesized sequence
DIQMTQSPSSLSASVGDRVTITCRASQDISSYLNWYQQKPGKAPKLLIYYCSRLHSGVPSRFSGSGSGTDFTFTISSLQPEDIATYYCQQGNTLPYTFGQGTKVEIK

SEQ ID NO: 398 - protein, 107 aa, Artificial Sequence
  An artificially synthesized sequence
DIQMTQSPSSLSASVGDRVTITCRASQDISSYLNWYQQKPGKAPKLLIYYTSRLCSGVPSRFSGSGSGTDFTFTISSLQPEDIATYYCQQGNTLPYTFGQGTKVEIK

SEQ ID NO: 399 - protein, 107 aa, Artificial Sequence
  An artificially synthesized sequence
DIQMTQSPSSLSASVGDRVTITCRASQDISSYLNWYQQKPGKAPKLLIYYTSRLHCGVPSRFSGSGSGTDFTFTISSLQPEDIATYYCQQGNTLPYTFGQGTKVEIK

SEQ ID NO: 400 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPCTFGQGTKVEIK

SEQ ID NO: 401 - protein, 107 aa, Artificial Sequence
  An artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYCFGQGTKVEIK

SEQ ID NO: 402 - protein, 107 aa, Artificial Sequence
  An artificially synthesized sequence
CTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 107 aa, Artificial Sequence
  An artificially synthesized sequence
RCVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - protein, 107 aa, Artificial Sequence
  An artificially synthesized sequence
RTCAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 405 - protein, 107 aa, Artificial Sequence
  An artificially synthesized sequence
RTVCAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 107 aa, Artificial Sequence
  An artificially synthesized sequence
RTVACPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 407 - protein, 107 aa, Artificial Sequence
  An artificially synthesized sequence
RTVAACSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 408 - protein, 107 aa, Artificial Sequence
  An artificially synthesized sequence
RTVAAPCVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 107 aa, Artificial Sequence
  An artificially synthesized sequence
RTVAAPSCFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 410 - protein, 107 aa, Artificial Sequence
  An artificially synthesized sequence
RTVAAPSVCIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 411 - protein, 107 aa, Artificial Sequence
  An artificially synthesized sequence
RTVAAPSVFIFPCSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 412 - protein, 107 aa, Artificial Sequence
  An artificially synthesized sequence
RTVAAPSVFIFPPCDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 413 - protein, 107 aa, Artificial Sequence
  An artificially synthesized sequence
RTVAAPSVFIFPPSCEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 414 - protein, 107 aa, Artificial Sequence
  An artificially synthesized sequence
RTVAAPSVFIFPPSDCQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 415 - protein, 107 aa, Artificial Sequence
  An artificially synthesized sequence
RTVAAPSVFIFPPSDECLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 107 aa, Artificial Sequence
  An artificially synthesized sequence
RTVAAPSVFIFPPSDEQCKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 107 aa, Artificial Sequence
  An artificially synthesized sequence
RTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - protein, 107 aa, Artificial Sequence
  An artificially synthesized sequence
RTVAAPSVFIFPPSDEQLKCGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 107 aa, Artificial Sequence
  An artificially synthesized sequence
RTVAAPSVFIFPPSDEQLKSCTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 420 - protein, 107 aa, Artificial Sequence
  An artificially synthesized sequence
RTVAAPSVFIFPPSDEQLKSGCASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 421 - protein, 107 aa, Artificial Sequence
  An artificially synthesized sequence
RTVAAPSVFIFPPSDEQLKSGTCSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 422 - protein, 107 aa, Artificial Sequence
  An artificially synthesized sequence
RTVAAPSVFIFPPSDEQLKSGTACVVCLLNNFYPREAKVQWKVDNALQSGNSQESVTEQDSKDSTYSLSSTLTLSKADYEKHKVYACEVTHQGLSSPVTKSFNRGEC

SEQ ID NO: 423 - protein, 107 aa, Artificial Sequence
  An artificially synthesized sequence
RTVAAPSVFIFPPSDEQLKSGTASVVCLCNNFYPREAKVQWKVDNALQSGNSQESVTEQDSKDSTYSLSSTLTLSKADYEKHKVYACEVTHQGLSSPVTKSFNRGEC

SEQ ID NO: 424 - protein, 107 aa, Artificial Sequence
  An artificially synthesized sequence
RTVAAPSVFIFPPSDEQLKSGTASVVCLLCNFYPREAKVQWKVDNALQSGNSQESVTEQDSKDSTYSLSSTLTLSKADYEKHKVYACEVTHQGLSSPVTKSFNRGEC

SEQ ID NO: 425 - protein, 107 aa, Artificial Sequence
  An artificially synthesized sequence
RTVAAPSVFIFPPSDEQLKSGTASVVCLLNCFYPREAKVQWKVDNALQSGNSQESVTEQDSKDSTYSLSSTLTLSKADYEKHKVYACEVTHQGLSSPVTKSFNRGEC

SEQ ID NO: 426 - protein, 107 aa, Artificial Sequence
  An artificially synthesized sequence
RTVAAPSVFIFPPSDEQLKSGTASVVCLLNNCYPREAKVQWKVDNALQSGNSQESVTEQDSKDSTYSLSSTLTLSKADYEKHKVYACEVTHQGLSSPVTKSFNRGEC

SEQ ID NO: 427 - protein, 107 aa, Artificial Sequence
  An artificially synthesized sequence
RTVAAPSVFIFPPSDEQLKSGTASVVCLLNNFCPREAKVQWKVDNALQSGNSQESVTEQDSKDSTYSLSSTLTLSKADYEKHKVYACEVTHQGLSSPVTKSFNRGEC

SEQ ID NO: 428 - protein, 107 aa, Artificial Sequence
  An artificially synthesized sequence
RTVAAPSVFIFPPSDEQLKSGTASVVCLLNNFYCREAKVQWKVDNALQSGNSQESVTEQDSKDSTYSLSSTLTLSKADYEKHKVYACEVTHQGLSSPVTKSFNRGEC

SEQ ID NO: 429 - protein, 107 aa, Artificial Sequence
  An artificially synthesized sequence
RTVAAPSVFIFPPSDEQLKSGTASVVCLLNNFYPCEAKVQWKVDNALQSGNSQESVTEQDSKDSTYSLSSTLTLSKADYEKHKVYACEVTHQGLSSPVTKSFNRGEC

SEQ ID NO: 430 - protein, 107 aa, Artificial Sequence
  An artificially synthesized sequence
RTVAAPSVFIFPPSDEQLKSGTASVVCLLNNFYPRCAKVQWKVDNALQSGNSQESVTEQDSKDSTYSLSSTLTLSKADYEKHKVYACEVTHQGLSSPVTKSFNRGEC

SEQ ID NO: 431 - protein, 107 aa, Artificial Sequence
  An artificially synthesized sequence
RTVAAPSVFIFPPSDEQLKSGTASVVCLLNNFYPRECKVQWKVDNALQSGNSQESVTEQDSKDSTYSLSSTLTLSKADYEKHKVYACEVTHQGLSSPVTKSFNRGEC

SEQ ID NO: 432 - protein, 107 aa, Artificial Sequence
  An artificially synthesized sequence
RTVAAPSVFIFPPSDEQLKSGTASVVCLLNNFYPREACVQWKVDNALQSGNSQESVTEQDSKDSTYSLSSTLTLSKADYEKHKVYACEVTHQGLSSPVTKSFNRGEC

SEQ ID NO: 433 - protein, 107 aa, Artificial Sequence
  An artificially synthesized sequence
RTVAAPSVFIFPPSDEQLKSGTASVVCLLNNFYPREAKCQWKVDNALQSGNSQESVTEQDSKDSTYSLSSTLTLSKADYEKHKVYACEVTHQGLSSPVTKSFNRGEC

SEQ ID NO: 434 - protein, 107 aa, Artificial Sequence
  An artificially synthesized sequence
RTVAAPSVFIFPPSDEQLKSGTASVVCLLNNFYPREAKVCWKVDNALQSGNSQESVTEQDSKDSTYSLSSTLTLSKADYEKHKVYACEVTHQGLSSPVTKSFNRGEC

SEQ ID NO: 435 - protein, 107 aa, Artificial Sequence
  An artificially synthesized sequence
RTVAAPSVFIFPPSDEQLKSGTASVVCLLNNFYPREAKVQCKVDNALQSGNSQESVTEQDSKDSTYSLSSTLTLSKADYEKHKVYACEVTHQGLSSPVTKSFNRGEC

SEQ ID NO: 436 - protein, 107 aa, Artificial Sequence
  An artificially synthesized sequence
RTVAAPSVFIFPPSDEQLKSGTASVVCLLNNFYPREAKVQWCVDNALQSGNSQESVTEQDSKDSTYSLSSTLTLSKADYEKHKVYACEVTHQGLSSPVTKSFNRGEC

SEQ ID NO: 437 - protein, 107 aa, Artificial Sequence
  An artificially synthesized sequence
RTVAAPSVFIFPPSDEQLKSGTASVVCLLNNFYPREAKVQWKCDNALQSGNSQESVTEQDSKDSTYSLSSTLTLSKADYEKHKVYACEVTHQGLSSPVTKSFNRGEC

SEQ ID NO: 438 - protein, 107 aa, Artificial Sequence
  An artificially synthesized sequence
RTVAAPSVFIFPPSDEQLKSGTASVVCLLNNFYPREAKVQWKVCNALQSGNSQESVTEQDSKDSTYSLSSTLTLSKADYEKHKVYACEVTHQGLSSPVTKSFNRGEC

SEQ ID NO: 439 - protein, 107 aa, Artificial Sequence
  An artificially synthesized sequence
RTVAAPSVFIFPPSDEQLKSGTASVVCLLNNFYPREAKVQWKVDCALQSGNSQESVTEQDSKDSTYSLSSTLTLSKADYEKHKVYACEVTHQGLSSPVTKSFNRGEC

SEQ ID NO: 440 - protein, 107 aa, Artificial Sequence
  An artificially synthesized sequence
RTVAAPSVFIFPPSDEQLKSGTASVVCLLNNFYPREAKVQWKVDNCLQSGNSQESVTEQDSKDSTYSLSSTLTLSKADYEKHKVYACEVTHQGLSSPVTKSFNRGEC

SEQ ID NO: 441 - protein, 107 aa, Artificial Sequence
  An artificially synthesized sequence
RTVAAPSVFIFPPSDEQLKSGTASVVCLLNNFYPREAKVQWKVDNACQSGNSQESVTEQDSKDSTYSLSSTLTLSKADYEKHKVYACEVTHQGLSSPVTKSFNRGEC

SEQ ID NO: 442 - protein, 107 aa, Artificial Sequence
  An artificially synthesized sequence
RTVAAPSVFIFPPSDEQLKSGTASVVCLLNNFYPREAKVQWKVDNALCSGNSQESVTEQDSKDSTYSLSSTLTLSKADYEKHKVYACEVTHQGLSSPVTKSFNRGEC

SEQ ID NO: 443 - protein, 107 aa, Artificial Sequence
  An artificially synthesized sequence
RTVAAPSVFIFPPSDEQLKSGTASVVCLLNNFYPREAKVQWKVDNALQCGNSQESVTEQDSKDSTYSLSSTLTLSKADYEKHKVYACEVTHQGLSSPVTKSFNRGEC

SEQ ID NO: 444 - protein, 107 aa, Artificial Sequence
  An artificially synthesized sequence
RTVAAPSVFIFPPSDEQLKSGTASVVCLLNNFYPREAKVQWKVDNALQSCNSQESVTEQDSKDSTYSLSSTLTLSKADYEKHKVYACEVTHQGLSSPVTKSFNRGEC

SEQ ID NO: 445 - protein, 107 aa, Artificial Sequence
  An artificially synthesized sequence
RTVAAPSVFIFPPSDEQLKSGTASVVCLLNNFYPREAKVQWKVDNALQSGCSQESVTEQDSKDSTYSLSSTLTLSKADYEKHKVYACEVTHQGLSSPVTKSFNRGEC

SEQ ID NO: 446 - protein, 107 aa, Artificial Sequence
  An artificially synthesized sequence
RTVAAPSVFIFPPSDEQLKSGTASVVCLLNNFYPREAKVQWKVDNALQSGNCQESVTEQDSKDSTYSLSSTLTLSKADYEKHKVYACEVTHQGLSSPVTKSFNRGEC

SEQ ID NO: 447 - protein, 107 aa, Artificial Sequence
  An artificially synthesized sequence
RTVAAPSVFIFPPSDEQLKSGTASVVCLLNNFYPREAKVQWKVDNALQSGNSCESVTEQDSKDSTYSLSSTLTLSKADYEKHKVYACEVTHQGLSSPVTKSFNRGEC

SEQ ID NO: 448 - protein, 107 aa, Artificial Sequence
  An artificially synthesized sequence
RTVAAPSVFIFPPSDEQLKSGTASVVCLLNNFYPREAKVQWKVDNALQSGNSQCSVTEQDSKDSTYSLSSTLTLSKADYEKHKVYACEVTHQGLSSPVTKSFNRGEC

SEQ ID NO: 449 - protein, 107 aa, Artificial Sequence
  An artificially synthesized sequence
RTVAAPSVFIFPPSDEQLKSGTASVVCLLNNFYPREAKVQWKVDNALQSGNSQECVTEQDSKDSTYSLSSTLTLSKADYEKHKVYACEVTHQGLSSPVTKSFNRGEC

SEQ ID NO: 450 - protein, 107 aa, Artificial Sequence
  An artificially synthesized sequence
RTVAAPSVFIFPPSDEQLKSGTASVVCLLNNFYPREAKVQWKVDNALQSGNSQESCTEQDSKDSTYSLSSTLTLSKADYEKHKVYACEVTHQGLSSPVTKSFNRGEC

SEQ ID NO: 451 - protein, 107 aa, Artificial Sequence
  An artificially synthesized sequence
RTVAAPSVFIFPPSDEQLKSGTASVVCLLNNFYPREAKVQWKVDNALQSGNSQESVCEQDSKDSTYSLSSTLTLSKADYEKHKVYACEVTHQGLSSPVTKSFNRGEC

SEQ ID NO: 452 - protein, 107 aa, Artificial Sequence
  An artificially synthesized sequence
RTVAAPSVFIFPPSDEQLKSGTASVVCLLNNFYPREAKVQWKVDNALQSGNSQESVTCQDSKDSTYSLSSTLTLSKADYEKHKVYACEVTHQGLSSPVTKSFNRGEC

SEQ ID NO: 453 - protein, 107 aa, Artificial Sequence
  An artificially synthesized sequence
RTVAAPSVFIFPPSDEQLKSGTASVVCLLNNFYPREAKVQWKVDNALQSGNSQESVTECDSKDSTYSLSSTLTLSKADYEKHKVYACEVTHQGLSSPVTKSFNRGEC

SEQ ID NO: 454 - protein, 107 aa, Artificial Sequence
  An artificially synthesized sequence
RTVAAPSVFIFPPSDEQLKSGTASVVCLLNNFYPREAKVQWKVDNALQSGNSQESVTEQCSKDSTYSLSSTLTLSKADYEKHKVYACEVTHQGLSSPVTKSFNRGEC

SEQ ID NO: 455 - protein, 107 aa, Artificial Sequence
  An artificially synthesized sequence
RTVAAPSVFIFPPSDEQLKSGTASVVCLLNNFYPREAKVQWKVDNALQSGNSQESVTEQDCKDSTYSLSSTLTLSKADYEKHKVYACEVTHQGLSSPVTKSFNRGEC

SEQ ID NO: 456 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSCDSTYSLSSTLTLSKADYEKHKVYACEVTHQGLSSPVTKSFNRGEC

SEQ ID NO: 457 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKCSTYSLSSTLTLSKADYEKHKVYACEVTHQGLSSPVTKSFNRGEC

SEQ ID NO: 458 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 459 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSCYSLSSTLTLSKADYEKHKVYACEVTHQGLSSPVTKSFNRGEC

SEQ ID NO: 460 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTCSLSSTLTLSKADYEKHKVYACEVTHQGLSSPVTKSFNRGEC

SEQ ID NO: 461 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYCLSSTLTLSKADYEKHKVYACEVTHQGLSSPVTKSFNRGEC

SEQ ID NO: 462 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSCSSTLTLSKADYEKHKVYACEVTHQGLSSPVTKSFNRGEC

SEQ ID NO: 463 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLCLSKADYEKHKVYACEVTHQGLSSPVTKSFNRGEC

SEQ ID NO: 464 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTCSKADYEKHKVYACEVTHQGLSSPVTKSFNRGEC

SEQ ID NO: 465 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLCKADYEKHKVYACEVTHQGLSSPVTKSFNRGEC

SEQ ID NO: 466 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSCADYEKHKVYACEVTHQGLSSPVTKSFNRGEC

SEQ ID NO: 467 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKCDYEKHKVYACEVTHQGLSSPVTKSFNRGEC

SEQ ID NO: 468 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKACYEKHKVYACEVTHQGLSSPVTKSFNRGEC

SEQ ID NO: 469 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADCEKHKVYACEVTHQGLSSPVTKSFNRGEC

SEQ ID NO: 470 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYCKHKVYACEVTHQGLSSPVTKSFNRGEC

SEQ ID NO: 471 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYECHKVYACEVTHQGLSSPVTKSFNRGEC

SEQ ID NO: 472 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKCKVYACEVTHQGLSSPVTKSFNRGEC

SEQ ID NO: 473 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHCVYACEVTHQGLSSPVTKSFNRGEC

SEQ ID NO: 474 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKCYACEVTHQGLSSPVTKSFNRGEC

SEQ ID NO: 475 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVCACEVTHQGLSSPVTKSFNRGEC

SEQ ID NO: 476 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYCCEVTHQGLSSPVTKSFNRGEC

SEQ ID NO: 477 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACCVTHQGLSSPVTKSFNRGEC

SEQ ID NO: 478 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACECTHQGLSSPVTKSFNRGEC

SEQ ID NO: 479 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVCHQGLSSPVTKSFNRGEC

SEQ ID NO: 480 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTCQGLSSPVTKSFNRGEC

SEQ ID NO: 481 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHCGLSSPVTKSFNRGEC

SEQ ID NO: 482 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQCLSSPVTKSFNRGEC

SEQ ID NO: 483 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGCSSPVTKSFNRGEC

SEQ ID NO: 484 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLCSPVTKSFNRGEC

SEQ ID NO: 485 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSCPVTKSFNRGEC

SEQ ID NO: 486 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSCVTKSFNRGEC

SEQ ID NO: 487 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 488 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVCKSFNRGEC

SEQ ID NO: 489 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTCSFNRGEC

SEQ ID NO: 490 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKCFNRGEC

SEQ ID NO: 491 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSCNRGEC

SEQ ID NO: 492 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFCRGEC

SEQ ID NO: 493 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNCGEC

SEQ ID NO: 494 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRCEC

SEQ ID NO: 495 - protein, 107 aa, Artificial Sequence
  An artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGCC

SEQ ID NO: 496 - protein, 115 aa, Artificial Sequence
  An artificially synthesized sequence
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSS

SEQ ID NO: 497 - protein, 112 aa, Artificial Sequence; identical to SEQ ID NO: 158
  An artificially synthesized sequence

SEQ ID NO: 498 - protein, 330 aa, Artificial Sequence [sequence omitted]

SEQ ID NO: 499 - protein, 326 aa, Artificial Sequence
  An artificially synthesized sequence
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 500 - protein, 377 aa, Artificial Sequence
  An artificially synthesized sequence
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 501 - protein, 327 aa, Artificial Sequence
  An artificially synthesized sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 502 - protein, 330 aa, Artificial Sequence [sequence omitted]

SEQ ID NO: 503 - protein, 326 aa, Artificial Sequence; identical to SEQ ID NO: 499
  An artificially synthesized sequence

SEQ ID NO: 504 - protein, 377 aa, Artificial Sequence; identical to SEQ ID NO: 500
  An artificially synthesized sequence

SEQ ID NO: 505 - protein, 327 aa, Artificial Sequence; identical to SEQ ID NO: 501
  An artificially synthesized sequence

SEQ ID NO: 506 - protein, 4 aa, Artificial Sequence
  An artificially synthesized sequence
GGGS

SEQ ID NO: 507 - protein, 4 aa, Artificial Sequence
  An artificially synthesized sequence
SGGG

SEQ ID NO: 508 - protein, 5 aa, Artificial Sequence
  An artificially synthesized sequence
GGGGS

SEQ ID NO: 509 - protein, 5 aa, Artificial Sequence
  An artificially synthesized sequence
SGGGG

SEQ ID NO: 510 - protein, 6 aa, Artificial Sequence
  An artificially synthesized sequence
GGGGGS

SEQ ID NO: 511 - protein, 6 aa, Artificial Sequence
  An artificially synthesized sequence
SGGGGG

SEQ ID NO: 512 - protein, 7 aa, Artificial Sequence
  An artificially synthesized sequence
GGGGGGS

SEQ ID NO: 513 - protein, 7 aa, Artificial Sequence
  An artificially synthesized sequence
SGGGGGG

The invention claimed is:

1. An antigen-binding molecule comprising:

(i) a first antigen-binding domain comprising a first heavy chain variable (VH) region, a first heavy chain constant (CH1) region, a first light chain variable (VL) region, and a first light chain constant (CL) region; and (ii) a second antigen-binding domain comprising a second VH region, a second CH1 region, a second VL region, and a second CL region; and (iii) a third antigen-binding domain comprising a third VH region and a third VL region, wherein the antigen-binding molecule further comprises one or more of the following;

at least one bond between an amino acid residue in the first CH1 region and an amino acid residue in the second CH1 region, at least one bond between an amino acid residue in the first CL region and an amino acid residue in the second CL region, at least one bond between an amino acid residue in the first CH1 region and an amino acid residue in the second CL region, and at least one bond between an amino acid residue in the first CL region and an amino acid residue in the second CH1 region;

wherein the first antigen-binding domain is linked to the second antigen-binding domain via an Fc region, a disulfide bond, or a linker, wherein the first antigen-binding domain binds to a first antigen and to a second antigen different from the first antigen, but does not bind to both the first and second antigens at the same time when the first and second antigens are expressed on cell membranes of separate cells, wherein the third antigen-binding domain binds to a third antigen that is different from the first and second antigens;

wherein the third antigen-binding domain is linked to one of the following: the first antigen-binding domain, the second antigen-binding domain, or an Fc region; and wherein either (a) or (b) is true;

(a) the second antigen-binding domain binds to the first antigen and to the second antigen, but does not bind to both the first and second antigens at the same time when the first and second antigens are expressed on cell membranes of different cells; or (b) the second antigen-binding domain binds to either the first antigen or the second antigen, and not to the other.

2. The antigen-binding molecule of claim 1, wherein one or both of the first antigen-binding domain and the second antigen binding domain have an alteration, compared to the VH region sequence of SEQ ID NO: 184 and the VL region sequence of SEQ ID NO: 185, of at least one amino acid at a position or positions selected from Kabat numbering positions 31 to 35, 50 to 65, 71 to 74, and 95 to 102 of SEQ ID NO: 184, and Kabat numbering positions 24 to 34, 50 to 56, and 89 to 97 of SEQ ID NO: 185.

3. The antigen-binding molecule of claim 1, wherein the first antigen-binding domain and the second antigen-binding domain are linked via an Fc region.

4. The antigen-binding molecule of claim 3, wherein the Fc region has reduced binding activity against human Fc gamma R as compared with that of the Fc region of a wild-type human IgG1 antibody.

5. The antigen-binding molecule of claim 1, wherein the third antigen-binding domain is linked to either the first antigen-binding domain or the second antigen-binding domain through one of the following linkages:

(A) a link between the C-terminus of a polypeptide comprising the third VH region and the N-terminus of a polypeptide comprising the first or second VH region, (B) a link between the C-terminus of a polypeptide comprising the third VH region and the N-terminus of a polypeptide comprising the first or second VL region, (C) a link between the C-terminus of a polypeptide comprising the third VL region and the N-terminus of a polypeptide comprising the first or second VH region, or (D) a link between the C-terminus of a polypeptide comprising the third VL region and the N-terminus of a polypeptide comprising the first or second VL region.

6. The antigen-binding molecule of claim 1, wherein the at least one bond is a disulfide bond, wherein the first antigen-binding domain comprises a heavy chain hinge region, wherein the second antigen-binding domain comprises a heavy chain hinge region, and wherein the first antigen-binding domain and the second antigen-binding domain are linked to each other by one or more native disulfide bonds between their respective hinge regions.

7. The antigen-binding molecule of claim 1, wherein the amino acid residue at EU numbering position 191 in the first CH1 region forms a bond with the amino acid residue at EU numbering position 191 in the second CH1 region.

8. The antigen-binding molecule of claim 1, wherein the first antigen is a molecule specifically expressed on a T cell.

9. The antigen-binding molecule of claim 8, wherein the second antigen is a molecule expressed on a T cell or any other immune cell.

10. The antigen-binding molecule of claim 1, wherein the first antigen is human CD3 and the second antigen is human CD137.

11. The antigen-binding molecule of claim 1, wherein the third antigen is a molecule specifically expressed in a cancer cell.

12. The antigen-binding molecule of claim 10, wherein the third antigen is a molecule specifically expressed in a cancer cell.

13. A method for producing an antigen-binding molecule, the method comprising:

(a) providing a host cell containing one or more nucleic acids encoding one or more polypeptides that together form:

(1) a first antigen-binding domain comprising a first VH region, a first CH1 region, a first VL region, and a first CL region;

(2) a second antigen-binding domain comprising a second VH region, a second CH1 region, a second VL region, and a second CL region; and (3) a third antigen-binding domain comprising a third VH region and a third VL region, wherein:

(i) each of the first and second antigen-binding domains binds to both a first antigen and a second antigen that is different from the first antigen, but does not bind to both the first and second antigens at the same time when the first and second antigens are expressed on cell membranes of separate cells, or (ii) the first antigen-binding domain binds to a first antigen and a second antigen that is different from the first antigen, but does not bind to both the first and second antigens at the same time when the first and second antigens are expressed on cell membranes of separate cells, and the second antigen-binding domain binds only to either the first antigen or the second antigen and not to the other;

wherein the third antigen-binding domain binds to a third antigen different from the first and second antigens;

(b) culturing the host cell so that the antigen-binding molecule comprising the one or more polypeptides of (a) is produced, wherein the first antigen-binding domain and the second antigen-binding domain of the produced antigen-binding molecule are linked via a first linkage and a second linkage, wherein the first linkage is via an Fc region, a disulfide bond or a linker, and wherein the second linkage is selected from:

at least one bond between an amino acid residue in the first CH1 region and an amino acid residue in the second CH1 region, at least one bond between an amino acid residue in the first CL region and an amino acid residue in the second CL region, at least one bond between an amino acid residue in the first CH1 region and an amino acid residue in the second CL region, or at least one bond between an amino acid residue in the first CL region and an amino acid residue in the second CH1 region; and optionally, wherein the third antigen-binding domain is linked to any one of the first antigen-binding domain and the second antigen-binding domain, or an Fc region; and (c) obtaining the antigen-binding molecule produced in (b).

14. The method of claim 13, further comprising preparing the host cell of (a) by a method comprising:

(1) identifying a starting antigen-binding domain that has a VH region of SEQ ID NO: 184 and a VL region of SEQ ID NO: 185;

(2) preparing a library of antigen-binding domains that vary from the starting antigen-binding domain and from each other at one or more positions selected from Kabat numbering positions 31 to 35, 50 to 65, 71 to 74, and 95 to 102 in SEQ ID NO: 184 and Kabat numbering positions 24 to 34, 50 to 56, and 89 to 97 in SEQ ID NO: 185;

(3) selecting, from the prepared library, an antigen-binding domain comprising a VH region and a VL region that together bind the first antigen and the second antigen, but do not bind to the first antigen and the second antigen at the same time when the first and second antigens are expressed on cell membranes of separate cells;

(4) preparing one or more nucleic acids encoding one or more polypeptides that together comprise the selected antigen-binding domain; and (5) introducing the one or more nucleic acids of (4) into a host cell, thereby preparing the host cell of (a).

15. The method of claim 13, wherein;

the at least one bond of the second linkage is a disulfide bond, the first antigen-binding domain comprises a heavy chain hinge region, the second antigen-binding domain comprises a heavy chain hinge region, and the first linkage links the first antigen-binding domain to the second antigen-binding domain by one or more native disulfide bonds in the respective hinge regions.

16. A method of treating cancer, the method comprising administering the antigen-binding molecule of claim 12 to a subject in need of treatment for cancer.

17. The antigen-binding molecule of claim 1, wherein the at least one bond is a disulfide bond.

18. The antigen-binding molecule of claim 1, wherein one or both of the first antigen-binding domain and the second antigen-binding domain comprise the amino acid sequence of the VH region of SEQ ID NO: 184 with at least one amino acid alteration or the amino acid sequence of the VL region of SEQ ID NO: 185 with at least one amino acid alteration, wherein the alteration is a substitution or an insertion.

19. The antigen-binding molecule of claim 1, wherein the amino acid residue in the first or second CH1 region is at a CH1 position selected from EU numbering positions 119, 122, 123, 131, 132, 133, 134, 135, 136, 137, 139, 140, 148, 150, 155, 156, 157, 159, 160, 161, 162, 163, 165, 167, 174, 176, 177, 178, 190, 191, 192, 194, 195, 197, 213, and 214.

20. The antigen-binding molecule of claim 1, wherein the amino acid residue in the first or second CL region is at a CL position selected from EU numbering positions 109, 112, 121, 126, 128, 151, 152, 153, 156, 184, 186, 188, 190, 200, 201, 202, 203, 208, 210, 211, 212, and 213.

21. The method of claim 13, further comprising:

preparing a library of polypeptides comprising a plurality of antigen-binding domains, each of which comprises a VH region and a VL region, wherein the members of the library differ from each other by one or more amino acid substitutions or insertions, or both, in their respective VH regions or in their respective VL regions, or in both; and selecting, from the prepared library, an antigen-binding domain that binds to both the first antigen and the second antigen, but does not bind to the first antigen and the second antigen at the same time.

* * * * *